United States Patent 12,059,441 (PROBIOTIC BACTERIAL STRAINS THAT PRODUCE SHORT CHAIN FATTY ACIDS AND COMPOSITIONS COMPRISING SAME) - sequence listing, part 15

SEQ ID NO: 30 - DNA, 3620427 bp, Agathobacter rectalis (residues 1-1,810,214 of 3,620,427)
gaagcattcatctgccaccacataaatatgcttttctttgcaatgccctattatttgcttcatgaaagtgcagtctgcaagataccctgtcggattgtttggatttgcgataaaaaatatatctgtatcatctgtaagcatatccattaaagcatcccgccgtgcagcaggagaaaaatcactctgctcatccagcaggaaatatccgatatcacagccgactgcacgaagcacatgctcataaccgaaaaagcctggggccggaagtactgctttttttggttttatggcatgagctatcgccataaaaagctctgaggctccgtttccgggaattacatcctcgctttgtatgctgcaaccttgctgagtgaaatactctgatatcgcttttttaaggccactgcacgccatgtcgggatatctgtctgcatacgaaagtgcatcactcatagcctctttaacagaatgtggtatgccaagaggattgatatttaccgaaaaatccatatttactttattgttgtatatgtcaccgccatggatgcttttcattcaagtcctccatcaattcttacatcaattcttccatattcaaagcaatattaaaacaagactcataaccgccacagataaaagctcacacaaaaacgcagtaatatacatcagcctgtttgcacgctttatatcctcatactctatctcacgcagaccgtctcctatgtattttttcttcacaagcttcccaaaatacactgcatcacccgcaagctgcacccttaaagctcccgcacatacggactctgtctgggctgagtttgggcttgcgtgattgaaacgatctcttttaaagatgtggtatgcatttttgccatcaaaatgcctaccaccgataaatgccgcagcaatcatcagatatgcactgattcttgccggtatgaaattgaccacatcatcaagccttgcagcaaatctgccaaaatacatatatttatcatttttgtagccaagcatcgaatccatcgtattcacagccttgtatacaaagccaagcaccggcccgccgattgccgtgtaaagcataggtgcaatcactccgtcagatgtattttcagctatcgtctcaacagccgcccttgtgacgcctgactcatcaagcacagatgtatctctgccaacaatcatggaaacagcccttcttcctgcatcaactccgtctgtccttagtgcatcgtacaccctcatgctctccacacgaagacattttgtggcaagaatctgccaggtcataacagcctctgctattaccccggcatacagatttatgctgtatgctgccacaagaataattaccgacattgcaaaagttgcaaaaattacagtaaaagcaagaagcatgcctcttttgtattttgttaaatttaattttttttcagagatattatatccggcatcacaattaagcctcttatcgagaaaagaaatgagtgagccgataagcctgaccggatgcggtataaaatgcggatctcctattaataaatcaagcacaaagcctgctataaatgcaaaaatatgataacacatatgttagtccttcttaaataaatcatagcgatatgggcactatttcattaaacactatctcatcgccctcaaccgccacctcgcacgagtagccacagccgtttttcacctgataatcatagtaatccatatcacagtaatggctcattatcgccatgatagtccctccatgcacaaaaaatactatttgtatctctttatcaggcatagccctattaagctctaaggcctgtgtgagcaccttctcaaagccacctatgcttcttttgcaaaactcttttttgctctctccgtttggaaaggcaagtgtaccaccactgtcaatccacgcctgatatgagtccctgaaacggatatctgtgctaagttccttatagttttttagctcccattcaccgaaatccatctctgcaaactcttttacggtatgaattttatggtgctgtgcgaccggcaaaataatctctgccgtctgtttgcagcgcctcattgggctggtaataattatctgctcctttaagctatttccctccaaagccttgtatacaccattatttagcgcattttctagttcaacaactccggcttcatcgagtggctcatctgtcctgcccagatatctgtgttctctgtttgagacagtgcagccgtgtcttataaatatacagtttattttattttctgaccgattccacatattatgcgaactacctcgtctgctttttttgcaagcagtatctctgctctgcctgtctgctccctgtactctctctcaaacgcatcaagaggcactatgccgtttccaatctcatcagcaatgactattgtatccttatttttctctgcaaattgcataaatttcaaaatatattcctgcagtggaagatttttctcaagcacagccctgataaaataatggaatttatctattatgagtatactctcatcatcgacggcaaaatcccatggccattccatgtttgatgccttatcattgcaggcattatcctttaggaaaaaacagtcgtacacatcatatttttctgattcttctatcatattttctagcacataatcaagctttccctgtgccactccgcctatcacaagcttcatattttctccaattccaaagtttaaaattcatagtacaacttttatcaaaattcttatccgtaccattcctatattcaaaacaaatatactaaataataaaagagacaccacccagtgccactgccatagcgcactcacatatacacacaaaataccctgccgtatcacctgtgatgccgccaagctcctttttggttttcacataataataccaaaagctaagtgctgccacaatgatcatggccaccgcataaggcagtgacacaatgagtaaaacagccatacacaatgcaagctggatgtatagtgcagccctcacgatcgttctgtgtgcagtgtctgcaaacataaataacaatccatcgctttttgccgatttaaatgacacaaccgctattccgcttaagcaccttgagatgaaaaagcctgcacaaaaaacaataaatgctttatcattcattatctgagaaaaagctcccatgaataataatccgtaggctgcaagcattataacggcaaatgctcctatatgtgaatccttaagtattgcaagcttttcctcccgcggtttgtatgaatgaaacgcatccattgtatccataaaaccatctatgtgaaatcctcccgtaaccgctatcggaatgagtgcgcctatgcatacatagcagatatccgccactccaaaatgagagtatatatatttccaaagcataagaagcagtccaatcacagctcctatccacggaaagaataccagcatgtacttcatgtcatcatcattccatttaaattgtggcataggtatctttgaatacatggaaaaagatactatgcacgaccttattaacttcataatacacttaacctccacactgcttcacttaaccgtcaccggaatgcctgcaaccacctcaacgacacgttctgccatcgcagcaagccctctgtttacaatccccattgcctttatgtaattcatcgttgattgatcatagctgactccgtcttcaaatacattgtttgtcacaattataagctccgcaacattttcacttaagatacttacatcttttaacacctttttactcacatggctgatttgagcagtatcataatccttcatattttcagggtcatccaaagcctctttttcagcttcggcagcctgcataccggaagcatctacaggtggaaacatctcatttgccacaaggtttgacatacactcaagcagtgctgaccgcccggtttttaaactgctttctgattgcagcttttcaactgcctttttaatatcacgagactgctcgatggtaataaagccttttccggcacgaagtcttctgtgcctgtctatcttccgctgcccctcatcatcaaatacctgcattgtggcaatgtaatatttttctttgtatcccttttcatttgacacgtgacaaatatacttttctgcatatgctgatttgccgctgccgctgccgcctgttataagtgtaatcatctatacgtacctctcatactgtgataccgagatatcgtcgaaggttgtccggcctttgtatacgctaagtgccatatccaaaagcgcaaacatcatcacagcacctgttccctctccaagcgcaagggatgctcttatgaccggctttacggaaagtgcctcacacaaaagcgccacggcaggctccctgccctcatgggatggaatgataaaatcagtaactccggaaagaagccttcctgctgccaacgcagaaaccatgcttatcactccgtcgagcacaacaggaatatggtataatgcaccgcctatacacactccgacaagtcctgcaatatcgagtcctccgactgtcataagtatctcaaaggtgtccttattatataaatcatacttttctattgcgctctcaattacacggatttttctctcaagcccactgtcgtttaggcctgctcctcttcctgtcactgtggccacatcgcaccttagcatggcggctgccattgccgcgcttgtggtggtgtttcctatacccatctcaccggttgcaataatcctgcagccgtctgccttacacccatgcactatttctatacctgctgcaatcgcttcaagtgtctcagccattgtcatggcaggctcttttgcaaagtttctcgtgcccatgcgcacctttctttgaagcagccctttaacactctcgtcactgtttattcctatatccactggaattgtatcagcctcggcagtcattgccatgcgtccgacagatgaagccttccttgccatggattttgcaactgcaagtgtcacctcctgtccggactgactgatgccctcagcgaccacaccattatccgcacacatcattacgaccgccttttttgagatatctatattttcatctcccaaaacagcgccgattttggccgttaaaagctcaaaatcacccatgccgtcgagtggctttgccaccgaatcccagtttgaacggatttttttgtacatttttgcatcaggtggcgttatttttaatttttttaattcttcaactgtaaaatggtcagaaataatattattttcaatcatatcttgcctcacgaagcatgccgtacactgcatccatatccagatactctctcagtgtgtccgcaagcctgtcatactgtttttccttgaaactcttatagcttacaatagcgctgtcattcacatcaatgccctttttatcggcaatataatccactataactctggcggcctctgcagtgtcaaaaatgccgtggatgtacgagccatacacatttctgccatcagatatgacattatttaactcatttttcctgtcagcacaagccccctgctcatctgaagctgcgctatatgcgctcttacccatatgtatctcatagcccagaaagtgacagcctgaaagcctgctcaatacaccatctacatgtgctatttcaccgcttgtctgaagccgtgtcttgctgtcttttagaacggtatctataggaagaagctccatgccacgcatatatccgccctcctcaacaccgtcggggtcggctattgaagccccaagcatctgatagcctccgcatattccaaaaaccggtatctcacaggagagctttttgacagctgcctcaagtccgttttgtctcatccacaaaagatcccccatcgtattcttgcttcccggcagaaatactatatccggatgacgcagctcatttactgttgacacataccgcactgttacctcggacatctgctcaaagacattgaaatccgtgaaatttgatattctcggatatctgatgaccgctatatcaataagcccatctgtctttttgtcaaagcgctctgtcaggctgtcctcatcctcaagctgtacatccatatatggcaccactccggtaacaggcaccctgcctctctcctcaagcatctgtatccccggatcaaggattgttttgtcaccgcggaatttattgataataagcccgcagacacgattcttttcctcatcggttaaaagcataagtgtgccaagaagctgcgcaaaaacaccacctctgtcgatatcacccacgagcagcaccggtgcatccaccatatgcgcaagccccatgtttacaatatcattttccttcagatttatctccgccgggcttccggcgccctctatcactatgatatccgcatactcctcaagctttttaaatgccttttttatatccggtatgagagttttcttgtatgcaaaatactctctcgccggcatgttcttaagcacccttccgtttacaatcacctgtgagcctgtattatttgtgggctttaaaagaataggattcatgcacaccataggcttaatgcctgctgcctcagcctgcatcacctgggcccgtcccatctcaagtccttcgtctgttatataagagttgagcgccatgttctgtgatttaaacggtgccaccctgtatccgtcctgtctgaaaatacggcacaagcccgcgacaagaaagctcttgcctgaattggacattgtaccctgtaccataattacctttgccatatatatacctgctgtctgaatttatgtggtagctttatcatgaatattaaactgtagtgtgaacagtaacttccttaaagctgtgccaattgttcctcaagaaaaggaatttttataatttttcctgtagagactgcatactcataaagtctgctgttaaactgctcatacgtgccaaactctgttctgtcacatataacgccctcgcatgcatcaataagctcctttgccttttcaataagggcatcgtctacaggctcaaagcttcttgcgctgacaatctcagcagaaagcgcctttgccgcaggataatccagatcattttcatagatgattcctgtcgcaaacgggataccctttcgctgtaagctcctgaagctttttctgcccaggccccctcctgctatgacaaatatcctcgcccttccatccggtttttccagctctaaatcctctcctgtttcgtcaaagcttcctgccgtaattccaaaaagccctgaaacatattggtcagtaaatacctcctcgggagttccgtatctgtccacatatctgccatctatacacaaaatatggtctgacacacgctttgccatatcaagctcatggagcgacatgataaccgtaagattcttctgtcttttaagcctttggagtattgataaaaactcaagcttgtactttatatcaagatatgaggtaggctcgtctaacactataatctccggctgctggcatatggcccgcgacagcatgacccgctgtctttgtccatcgcttatctttgtaaaatccttatcttttatctgtgatacattgaccagctccatcgcctcatccacagcctttttgtcctcatccgaaagtactccgaaccggcctgtgtatggatatctgccggttgaaaccacatcatagcaggtcataagctccgtctttagcttatcggtgagcacaacagccattttctttgcaaattcattgccattcatcgtcactacatcacttttatcaagatatatcgtaccgctcacaagcgaaagctgtcttgcaatactttttaaaatagtcgatttaccggcaccgtttggcccgattaatgtgagaatctctccccttttaagggaaaaatcaatattttcaataagcggcctgttatcatatccaacggccagcttttcagcagtaaaataatattccatcagacatttttctccttgctgcgtcttatcatgataaacagcactaccggtgcaccaaatactgccgtaactgtgctgatactaagctccgtaggcgcaaacatcatcctcgcaagcaaatcacaaaacaggcagaacaccgctcccccaaggaagcaggccggtatcatatatatgggctttgtgctctttagcatgctttttactatgtgtggcacggctattccgacaaacgatatcggtcccgcaaacgccactatacatgcggaaagcaggcttgaaagcaataccagaagcacccggatgcgctttatgtttacacccagatttacggcatatgactctccaagctgatatgccataagtggctttgacatgagaaaaacaaagataaatgtgattcccaccacaatgctcatcaccccgacgctgtcccatgtcatgcccgaaaagcttccccttgaccagttatgcaggtttactatgtcggaatcatctgcaaatgtcaccacaaactcagtcaccgcagagcatatgtagccaatcatgacaccgctcaccacaagcattgacatgctgcttacctttcttgaaatgataagcacaaagcccattgaaagcattgctcccaaaaacgctgctgcaatcatggctagtgagctcacacgtatggcatttccaagtaaaaataccataacaagtgccacaatcatcttagctcccgatgatatgccaagtacaaaaggtcccgcgattggattatggaaaaaagtctgcaaaagatagcctgcaagcgctaacgccccgcccagtatcatcgctgcgatagctcttggcatgcggatatcccacacaatacgtcctaccctgtctgagtggtcataaagtgtcgcaaatgcatccttaaatgatatgtgtacagttcctatacacacattcatgataagcaatatgataattaagattataagaataataaatgttgtaaaacaccttatttttctggttttttccatgttgtagctccgctttttatctttttgtgctattgattttcctgttgagcttaaacagatatttcatgccgctgtcgggtgcacctgtaatcatcgaatgcatatcatcaatcatatacccgatagacatagactgctgatacatatcgttcgtggtgcaaaatacattgccgtctttgactgccctaaaatcagcaagcaccgggcacttgtccaaaagctcattcagattcttcacaccgccgtctatcgcactgttatatatcagatagtcagcatctattgctccattgtagaaatcctctagctgcatattcatggttgacctgcctgtatcgtcgtcatttgacgcatcaaaaatatattttccgccggcaagcgaaatcatctttggcacataatctgtacttttgcgcacctgaacctgtccattggacgtgatatagaaaaatgcaactgtcggtctgctatcatcatttgcagcagtatctgtctttgcgatgcgatttacaatatccacctgctcattaaagagctcatcggccttttcatccctgtctgtgagtgctccgaaaaacttcacccactccactctgccgagcggctcctcctcatagcttgagtactcgattattgaagggatatcaaagcttttaagcttttccgttacctgtggcgaatgggtaatcatagtattttctatggcaagagaacagttttctgacaccaaaagctcataatcgggttttgagtatttgccggcatatagcattctgccactttcaagagcctttcttgcactgtcaatgtaccagccatcactgtcaagccccgaaaatttaatagtgtccactgcatcaagcttgtcaaacatatccatcacccctgatgcgaccagatacaaatcacttacaggctccttcaatacaatgatatccttgtcaatatcctttggagtctttctgccttttggcacggtaagtatttgggtaccgtcctttgtagtaagtatcttgtatccaccctcataatagtcaacagaaaaattctttgcatataaaagcttcatactgctcttatatataagaccgttttgtgcctctgcctcagccttcgattcggtattccctgaatcggaagaaggactgtcacagcctgacagccagaacagtcctataattgatatcaatatatatataattatcttttttcttccatgcatagcttaattattctccatcctcaccaagcacctctgtagcagaatctgaatggaaggtgagtgtgtactcaacctcgtgcggcttgctcatagcaactgtatctccgataacctgcataggtgtatcaagcttaaccggaatttcaaatacagaattgccgtctgtatttacaggcatgtatttctgtccatcaactatcatatagtcatagtttggactgctccactgcactgttgcagtagcggctccaccacttatagtcacctcagccggtgatgcaatgctcgccttaccgcttccgccctcgaaatcgagattgatattgtatgttccgtcaggaagctcttttcctgcactctcagatacgcttgcatctgcgtccgcaggtgtggcatttgagacctttaccttgtggtcataccatttgccctttgtaccgataagtgcaaggtcaaattcctcatccaaaacaggaaccggtatatcaaacgcattgacctcctcagttgtgccatcgccataatcgacagtctcaacagttggctccaaaagctcagccttgtcctttgaggcatcctttgctgttcccaaaaagagatttacaatgtgtgtggatgtaagagcaacatgtattgttgccttgccatccttcacggtgagtgtacctttgttgtcatatgcatcattcacatgaaacattgagctgtctgtagtaaactctgctgtatatgtaccatctgaaagtgctatcttctctgtcgcgctctgcactgtttttttgctttctgtttcagcttttgcattcttattgccgcaggctgccaggctcatggcacaaaccagtgtcattgcaacgatataagtaaacttgtttctgaataattttctcatctctgatatactgctcctgttattttatagcttccccactatacatttaagtaactgctacttgctcatggcaaccgctgtatgctcaacataaagcttctggataccctcaatctcgccaagtccgttaatctgtgtatcgattttatcaaactttcctgatgccttaaactgtgaaagccatgaatcatcatcacttcctgccatatcattgttggcatggtctcctgcaacaaccataagcggacgaagaatgacgttcttgtaaccagcggctgacaccttctcaatgacagactcacatgatgtatcctccggctcaccctctaccgttccgataaatacgttttcataacccaaagctgtcatctggctctgcatctggctgtatgaaatctttgctgtatggcttgttccatgtcccataaatacaaatgctgtgccctcttcctttgcagcatcaaggctgtcatagcctgccttttctactgcttcctctgtaagaatttctgcaacggcctttttatcctcatttacaactgttgcatcacttccaacctcaccgaggagtggctctgcaatctttacagactcaaatttgtccttatacttctctacagcctctgaaagctcatcatactctgcgccatgcatcaggtgtgtaggctgtaccacaagattctttacaccatttttgactgcacgctcaagtgcctgatccatattgtcaatcttctcgtcatctcttgcctgtacatgattgatgataatctgtgctgtgaaggctcttctgactgaccagtcaggatttgcagctgctattgcatcctccacacccttgatatcagccacacggctgtcgttgaaggatgtaccaaagcttactacaagaatctcgttctcgccgatatcatcctggtttctcggatcatcctttgaagcatcgcctgtatctctgccgaaatagtcaggatcagcattttctccctctacaagctccttctgtgcgtctgtgagcttgtcccaggcctccttagcctccttgcactgcttgtctgtatcatctgttctctcctgcacgtagattgcatcgattaaatctgccacatgcattgccgcctcctgatctgcgtttgcgcttgtctcactctctgaagtcttagatgcctgtgtatcattctttgcatcatctgcattgctgccacagccggtcactgctgtcatagccataactgctgccatcagtactactactaatttctttttcatgttttctccttttcattctccttgcagctattaagctgcacatgttttaaatatgtaagacgaaaacatttaaagcgtcaaaaataaaagctctttgtactattatgtcaaagagctatacatgtcaaaatccttctaacacagactatacggctatcataaccttgtctgtaattataattatttcatcacgtacagccagttactcgtggcttgaaacactattgtttccgtacaacacaaaggcaggtatcccggcttatatatcattgcttcggccgtcttcccggttgcccagtgacttattggccgtcactccttaattacggtgacgagttcgtacaggatttgcacctgtttcccttttcaccggagccagcttcacatcgcctgtcataaatcagattcaaatgcttgtctgctccgacacctttatgctacatattcagtttcttcgtgcgttgcttacgcaatcgcttggattattatattacaacttgtaacattattcaacaaatttttatcagacgctttacacacacatttacaaaagcggtgcaaaaagctgcaaaatactctgcagcagcctgcctgcaaatgagatatcatttgtgctttcctcatacacctcctctgaaaccgcaaacgtctctatcgcatcctcttttatttttctgatgcactgagtcctgtacatgtatacaaaatcctcaaaattccaatacatgctcctgaaatccagattgcatgtgccaactatcgcagtatcatcatctgccactatacactttgaatgtataaagccgggtgtgtatagatatatccttacccccgcctcgataagaggtctgaaattggcttttgtctgcagataaatgagctttttatcgggaatcttaggtacaacaatacgcacatcaacacctgacctggctgccgatatcatagcatgtgacagctctgttccaagtatcagatacggtgtaaaaatataaacatattttttagctcttgagatgatactcacataaagattctctcctacatcatcatgctcaagcggtgaatcgcaaaacggctggacaaaaccgctttcctctgactggctgaaagtattgtgtggattcagatattcatcatgcacagcattgtccttattgatataattccacatctcaaggaacatcgtcgtgaaactgtttacacactctccctccacacggataccggcatccttccagtaaccaaacctgatttttttgttgatatactcatctgctatattgtaaccaccggtatgcgccacacgtccgtctatcaccagtatcttcctatgatccctgtcattcataattactgaaagcatgggcttatatggattgaagcgtctggtctgtattccgatgctctccatctcctttataaaatgtggcggaatggcatttatgctgccaaaatcatcatatatgattctcaccacaactccatgctttaccttttctttgagtatatcaagtatctgatcaagcataacgccactgccgattatgaaatactccataaagataaacttttcagctgaccttaaatcttttaaaatgctctcaaaagcctcctcacctgatttaaagtactctgtgcagtcctccgcatacagtggatatttctgattttgagtgataagcctgctttgtctgtatgcatccatatctgtctgtctgagagtctcatttagcagctcgttctcaggccgaagcggcgcatatgcttccacaattcttgccattcttttctgtgtcttcgacgtaagctccggtcttccgaaaaagaaatagcacggaataccaacgattggaacactcagtatcaaaaatatccatgacatttttatatacattttcatccgcctgttgacaatataaagcgaaagcaatatagctgccacatacatcagatcctgaaacaccctgctggcaacagaggccgtataaaacaaaaagaaccaccatatcatctgtatgattattattgtcgaaactataaaaagctttgaaagcagtctttgtaatatttttctcatataagccctaccatgaaattacaattatacaacctaatatttcctatattatctataataaatctctaatacatattataatattcccaccaatttatcaacatttataatcccccacgagcctttgtgactatcccctgccctgtcacatgtattatacagtgctagcttaaccgcctccggtctcatatttggatttttttccaatagaagtgctatggcacctgacacaatcggtgtagccattgaagtacctgttttccttacatatgtgccatctctcgttccaaggcttatgatatcatgcccgggagccagaatctcaggctttacaatacaacagtcggtaggacctttgccacttcttatatcatcaaagcttccgactgttattatttttcttgaaattcccggcacagttacagaaaacggtgccgggccgtagttgcccgctgctgcaacaactaccactcccatatcccacaattcatctatcagcttcaatatcttaatacgctctgctgtatcagaacatggcagatatcctacagagaagttgagtatttttatattaagtctgacgcagttttcttttatatacttaagtgcacgaattgaatccgctgtctgccccatgccaagataatcaagcaccttaaacacatatagtcctgcccccggagccatgcctatatctgcagccgataatataccgcacacatgtgtaccatgcccgttatcgtcataacatgtctcctttccacccacaaaatccataaagtgctttatacacccatcaagctgtttgtgtttaaacacacccgtatcaagcactgctatattgacatttttaccactatatccatttttatataccagatttgcatttatactatatttcgcatttttaattattattttattttttaatttagtatatgattcgttttcacaatatgacacagcttcgctcatagtatgattaaaggggcaaaataccttttgaccctcatatcatagtattaatcactacgtgaacccatacacaaacgcacctgttctgtcctaactcaaacctcattactataatttcatatattaaaaggactgcacctgcgtgcagccctttacctggatattattgttatactttaacgtatattaattaatcctcttttacatccttcatagagaagctgattcttcccatcttgtccttgccaaggcaaacaaccttcaccttgtctccaagtgtgagtacatcctctactctgttgattctctcttttgcaatctttgaaatgtgaaccattccctctttgccaggagcaaattcaatgaaagcaccaaactccttgatgcttacaactgttccctcaaggatctgtccctgctcaaaatcagttgtgataatcttaatcatgtcgattgcctttgcaatcatctctttatctgttccgcaaactgaaacagcgccatcatctgtgatatcgatcttgacaccggttctgtcgataatctcgttgattgtcttacccttctgtccgacaacatcaccaatctttgatggatcgattgtaatctgctcaatctttggagcccactcatttacttcttttctaggctcagcgattgccttgctcatgacctcatccatgatgtagagacgtgcctcacgtgttctcgcgattgcctcctcaacgataggtcttgtaagtccgtgaatcttgatatccatctggatagctgtaatacccttatgtgtacctgttaccttgaaatccatatctccgaagaaatcctcaagaccctggatatctgtaagtacaatgaaatcatcatctgtatcgcctgttacaagtccgcatgagattccggcaaccatagccttaatcggaacacctgcagccataagtgacatacatgatgcacatgttgaagccattgatgtagagccgtttgactcaaatgtctcagatacggcacggatagtatatgggaactcctcaatgcttggaagtacaggaacaagtgccttctcagcaagtgctccgtgtccaatctcacgacgtcccggtccacgtgatacctttgtctctcctacagagtatgcagggaagttatagtgatgcatatatctctttgttgtgatatttgcatcaagtccgtcgattttctgaatctctgataaaggagcaagtgttacaacatcacaaatctgtgtctgtccacgggtaaacattgcagagccgtgaactctaggaatcaaatcaacctctgctgcgagtggtctgatctggttgattgcacggccgtccggacgcttatgatcctttaaaatcatctttctgactgtcttcttctgatactggtaaatagcctcaccaagtactgcaaggtactcctcattgtcagcgaaggcttcctctaactgctctgtgatagctcttatattttcctcacgcttctgcttctcatctgtgaatactgcctcctccatctgctcaggagtaacaattttcttgatatcctcaaacatctgctccggaatagcacagctctcatactcatgctttggcttgccaatctcatcacggatctgatccataaatgcgataactgtctggttgatatcgtggcacttgtagattgcctcaatcatctgatcctcaggaatctcattggctcctgcttcaatcatgatgaccttttcctttgtagaagcaactgtgagctgtaaatcgccctcatcccactgcttctgtgaagggtttacgataaactctccatcaacaagtcccatctgtgtcatggcacatggtccgtcaaacggaatatctgatatatgaacagcaagagctgtaccgatcattgcaactatctcaggacggcactcaggatccactgacatgacaaggttgtttaatgtaacatcatttctgtaatcctttgggaaaagaggtctcataggacggtcaattacacgatctgtaaggatagcgttctcagatgcctttccctcacgcttgttaaaaccacccggaatttttcctacagagtacatcttctcctcgaactcaacgctgagtgggaagaaatccacaccgtcacgtggcttgtcagatgctgtagctgttgaaaggactgttgtatcaccatacttgataaaaacagctccgtttgcctgagctgctactcttccgatatctacagtaagagtcctgccggcaagttccattgaataacttttgtacatattaattctccttaaaaattcttttgcagaagtgtattcctcttccgaaactactaaacaatacatgtatgctcatgcactctttagtggtctcggcttacttctgcttttcaaaaaacaataataaaaacaataatagagcggaataataattactccgctctaaagaaaatactattttctaagtcctaaacgctcgataagtgaacgatatctctcgatatcaatctccttaaggtatgcaagtaatccacgtctctgaccgatcatctttaacattcctcttcttgagtgatgatcctttgggttctgtttgaaatgctcagttaactctgcgattcttgctgaaagaattgcaatctgaacctctggtgaacctgtgtcatttggtgttctaccgtactctgcgataatagcctgtttcttttcctttgcgatcattgttgatcctccttatattataatgcgccctgataactgtatgatgctcagcaataggtcggagtgtccaactaccgaacatgggcaaaaccacacttatgcagtatagcatagtaagcatttgttgtaaactgtttttttattaatccggcaaatatcttacgacacaaatcggatttctgtaatatgcatttgaaaccttgattccatcacgcttgttgctggcatgtacaatctgtccgtttccgatataaattgcaacatgtgagatactccttccacttccgtagaagaataaatctcccggctttgcttcagatgcactgatttttgtgccgtatgaaggctgtgctcttgatgaatgcggtaatgagattccatactttccaagaattctcattgtgaagcctgagcagtcaactcccttctcaaggcttgtaccaccccacacatatctgtttccgacaaactgtaacgcatacgatacaacagatgcccttacatctgatacgccgtcaccatacttcacctgctctattgtctttgctgtaggaagtgcctgtgccagtgtcacataatcctgtgatatatatcctaccgaatcatccacacttatctcaacccagccgtcagcgacagaattaaccgtgaatgcctctgaatttccaacctgcgaaagcaccgcagcctctgttgacttctctgcacgcacattcagtgtttccgtatttactgtggcaaccgtcttaatctcctgttctgcaatagcctctgcctcatctcctgtcacaagatactgcttgtttacatatcctgtcaccttgcctgatgtgaccttgtaccattctccggcatcctcaagaagctcacaggcattgtgattggtaagtattcctattacctcgctgtctgtcgaagcttcctgtctgatatttaagtttccgctgctgataaccgacataccaagatttgtgtaaccacaggtctgtgcggctgtcggtgtctgggatgcctcatttgcctgttctgtctcctgtgcagtattgccaacctgtgcaccctgagcagatgcagtaacaacattgctgttgttttgcgctaccgatacgtcagctccataataagtaagagccgatgtaacccctgctgtgagaagctctgtggcatctgccgcctctgtcagaccaagggccacccccgcattgactgttctgttttcctttaatgatgttctggcatctactgtgctgcttgaactcatagatacagcacctataataatagcaaacgctacaacgcctgctgcctgtcctaattttaatttatttttcatatagcctccagttcatgctatccataatcccatgtttacgagtatatcacaaattgttaaaatgtcaatatttcttcgtaatatttccgtaatatttgtcattttttcgttattttgggtaatttcgcaaaaaaacagccacactagaatgtgtgactgcctgcataattaattgtataattgatatctgcactcatctggctctttaacgcttctattgaatcaaacttcatctcaggtcttacgaacttatgaagctctaccatgatatcctgtccgtaaacatcctgcccaaaatctatgatatatgtctctgcaccgattggatttttgccctctatagtaggcttgcatcctatattggttacaccaaggtaccagttgtccctgacaagaactcttgacatatacactccctttggtggaagcagcttatcgtgcggcactgaaaggttgactgtcggaatgccaatagtcctgcctagtgctctgccatgcactactcttccttttatgaaaaagggataccccagcagttcattcgcctttttaatatgtcctgccgcaatctcctcgcggatataggtactgcttatatccctggctccatcctttatcttgtcaaccacaataagctcgtatccaagctctcctgccatcgcagaaagcagccgatggtctcctgccctgttgtgcccgaaacggaaatcatctccgacaatgatacacttgacattaagacttttaactatccatctgacaaacgcatccgcctccatcgtcatcacctgtggcacaaacggacactctatcagatagtcaatacctgatttttcaaacacatactctttttcatcgtttgtgattataacctttgactcaacgccaagtacctccgatttgggaggaatgtcaaacgtaaatatgatgcgcttgtaaccatgcagattgctctgttcaatttgcttttccatcagaaattcatgtcctctgtgaagcccgtcaaactttccaaacgagatgacggacggctccttgacatgaaaatccagagttttgcttatatattccataatatctgtatactattctattccataaaaatcttaaccggcttaaactcaccggtctcatcaagatacgaatacaccccgacaaatatgccctcatgattgtatactctgtatcttatatcagagtcagcactgtgttttaaataatccgtaagcactgccggaattttatttccatttctgacaagcttatcagcatctgaagcagtatgcactgccggcagattttcgaatactccgtcaacaggcatcaccatatcaaagcagccttcatccacctttgactgaatctgtgaaagtgtaagtgcatgctctaagtcaaagcctgctacccttactctaagcagtgacttcatgcagccatggcaacccagcctctctccgatgtcattgcacagcgtcctgatatatgtgccctttgaacagtgcaccgtcatcgtaacctccggtaaatcaatgctttcaaccttgatatcaaacacctcgatatccctggcttttctctctataaccttgccctccctggcaagctcatagagctttttcccattgacctttagagccgaatacattggcggcacctgcttttgtctgccaataaactgtgatattgcatcatacaccgcctgctcagtcacattgacctcagcctgatttaagacctgccctgaaatatcctgtgtatctgtctcctgtcctaaaagcagcacagctttatagaccttgtccttatctgtcaaaaggtcacacactctggttgcctttccaaggcagacaggaaggacgccttgcgcatcaggatcaagtgtacctgtatgaccaatcttcttctggtggaatatgcctcgaagctttgccacaacgtcaaagcttgtatagcccttttccttgtatacattgattattccattaaccatctgcccaagaatctctccctaaatattatccttaattgccgtaaggatgcggtctgttgccacctcaagtggtccttcaatcgtaaatcctgcagcctttacatgtccaccgccgccaaataccgacgcaacctttgccacatcgtaatcaccgtttacgcgcaggctgcccttgtaggtaccatcctcattttcgtagagaaatacagcaacctttatatcctttgtcacgcgcagctgatttacaataccgtcgagatgctttggaagcacatcgtacttctccatctcagcgcgcgatactgcagacaatataacatcaccattcagatacaaagcagcattcaaaagtgcctgccccataatcttgttctgagcaaatgtctttgtataaaatgtatcatcgattatccttgaataatcaatgcccatctccatcagggagcctgctatatccatagtcttttttgaagtgcatgaatactggaacacgcctgtatcatgcaccatgcctgtgtaaatacactctgctatctgtattgtaatgcgctccttaggcagaagttcaaacacaagctcacaggttgagctcgcatccggaaagatgtaatttgcgtctgcaaaggccccgtttgtaacatgatgatctatgcaaagtgtcctttttgcagactcaaaatacttagctgcacttcccagtctgcctgtgtcactgcagtcacatgctatgaacagatcgtatactgtatcatccgcatagctgctgtcaatctcatctgctctttgcatgaacttaaagatgttcgggcttggctctaaataaagccttgcctttatatcaggataataatcctttatgtagttgtataccgcaagtgttgagccgacacagtctccgtccggtctcacatgaccggaaacggcaactgattgtgcatcctttaaaatagaatcaatctctgtcataatcaatcctctttgttaatcctctttgagattttttgttacttcatcaatctttttagacatctcaacaccatactctatagactggtctatgataaatgtaatggcaggtgtatttcttaaattgatgttctttgcgagagttctgcgtatatatccctccgctgacttaagtcctgcaagtgtatcagcctgtgatttcttgtcaccaagcacactgatataagcctttgctgtctttaaatcaggtgccacctcgacagcaacaacacttgtcatgggattgatacgcggatcctttatctcaccgcgtatgatatttgacagttcacgcattacctcttcgttgatacgaatattttttatgctgttctttctcatataatcccgctttctttttatattaaaccgtaactatccgaatagctacattaattcaagataaacaatatatgattatctcggaacctctaccatcttgtaagcttcaactatatcgaattcctgaatatcattaaatccgtcaaatacaagaccacactcatagcctgtcttgacctccttgacgtcatccttgaatctcttgagtgaagcaaggtctccctcgaatatctgctcaccctctctgctaattctgacacggcagcctctctccataaatccgtcaagcacatatgaacctgcaatgtttccaacgcctgaagccttgaaaatctgtctgatttccgcatgtccgataaccttctcctcaaatacaggatcaagcatacccttcatggcagcagatacatcctcgattgcattgtagatgaccttgtaaagtctgatatctacgccctcacggtctgctgtagccttggcaacaggatccggtctgacgttaaagccaatgatgattgcatttgatgctgatgcaaggataacatctgactcgttgatggcaccaacgccgccatggatgaccttgaccacaacctcctcatttgaaagcttgacaagactctgcttaacagcctcaactgaaccctgtacatctgcctttacgatgatatcaagctccttcatgttgccggactgaatctgtgagaacagatcatcaagtgacatctttgcctttgtatcctcgatgagcttattcttctcctctgaaatatatgtgtcagagaatgcctttgcctccttctctgaatcgcatgccacaaatgtctctcctgctgaaggcacactgttgagtccaagtatctctacaggtgtagaaggcttagcctcctttactctgcggcccttgtcatcaatcatggctcttaccttaccatagctgcttccacatgcgattggatctccgacatggagtgttcctttttgtacaagcactgtggcaaccgcaccacggcctttatcaagctgtgcttcaattacgagacctcttgcgtttctatcaggattagccttgagctcgagcacctctgctgtgagaagaatcatctcaaggagattgtcgataccctccttagtatgtgcagatacaggacagaatattgtgcttccgccccaatcctccgggataagctcatactctgagagctcctgcttaaccttgtcgatattggcacttggcttatctatcttgttgactgcaacgataatctcaacacctgctgcctttgcatggtttattgcctcaacagtctgcggcattacaccatcatctgcagcaacaacaaggattgcgatatcagtagagtttgcaccacgcatacgcattgctgtaaatgcctcatgtcccggtgtatcaaggaatgtgatgttctggccattgattgatacaacagatgcaccaatgtgctgtgtaataccacctgcctcacggtctgtaacacgtgtctgtctgatggcatcaagcagtgatgtcttaccatgatctacgtgacccattacgcagactacaggtggacgaggaaccatcttgctctcatcctcttcatcctccttgagaagctctgcaatcacatcgaccttctcctcttcctcacatatgaaattgaactctaaagcaatctcctcagcggctgcaaaatcaacttcagagttaactgttaccatctcgcccttcatgaaaagcttctttacaatggctgaaggctgaaccttcatcttatcagctaaatcccttattgtaatcttctccggaagagaaattgtcttaatctcgttctcatcctcttttggctgtgccttcggctgctgtggctttttcttaccgccgtgcttctcgagattgatgtaattctcctgcttctttccgagcttatcctgcttctggctctgattgtgattatgcttattctttctatcgttgcctctgtcgcggctctcctttcctcttacatcatcaggagctgcaactgcaactgtttcttttctgaaacgatttctgtcatcacctctgctgcctgttctatcgttatttctatcattgctcctgcttctgtcattgcttctgcttctatcattatttctgtcaaagcttctgccaccctctgcaggacgtctggcgtcatttctgaagcctcggttattgtctctattattgtctctgctgttatctcggttattgttgtcgcgattgtttgttcttctatcgctgtttctgtccgtatttctgcttctgtcggcatttctgtcagtgtttctgttgttgattctgtcgccattgtcctgacgtctgtcgcttcttctatcagcgtcagcctgacgtgccggacgcgaattggttaccttcatatctgcatacggatccgctgtacgctcacttatagggcgcatagctctctctccgacaggtcttggcttaataatgctgtgctgctcaggacgtgatgactgattatcgcgtctgccattgccatttctgcgctgcgaactgttatttccattatttccgctgccgtttccaccatttgttttcctaccctgcttactgtactgggcattgaaaactgctgtgatgcttgcctttttctttggtctgtcggctgccttagcctcatcctttttaggttcttcctttttaggttcttccttcttaggtgcatctttttttacttctgttttcgcgtacttctttcgtacaatttgctgtgcctcatcctcaagaccgctctgcacatttttgacagcaaactgtgtgccgtttaatgtgtctatgacttcctgcgactttatatttaattcttttgcaagttcatgaactctcatttttgccatatatctattttcctccattattcagttttattcgactgcagcttttttatcactgcatttgcaaggttttcatccgttactgcaagggaagcgcgaaactctttgcctattgcattccctaaccccaccttgtcactataaaaataaatcggaacctcatagaaagcagtcatatccgaaaaatgcttctttgtgttgtctgatgaatcatctgcaactatcactaaaaatgcctttcctgtctttacagctttctctgtagaaaactctccgctaaccacattgcctgactttgctgctaatcccagcatagaaagtactctatctgtcaatttggttcatctccttttcaagctcctcatatacctgttctgatacactaacaccaagggaacgctcaagtgcctttgtctttttagcctttttaaagcattcaaggctcttacatatataagctcccctgccgtttttcttgccggtgtcatcgagaattatgtcgccctccgcagtctttaccacgcgaataagtgacttcttttccttcatctcctgacagcctacgcatttgcgcattggaatctttttatttgccattactgctcatcaccactatctgccgcatcattttctgtacctgctgcttcgttctcgtcagcctctgtatcaaaagcctctgcctgtacatctgcctgttctgtatcagctaatctctcgttctcagcaagctcatcatccgaataatcataatcgtcatcataatcatcctcttcatagtcattctcataatccatgaagtcccctgactctctagcctgtgtctcgctcttgatatcaatcttgaagcctgtaagtcttgctgcaagtcttgcattctgtccttccttaccgattgcaagcgaaagctgataatccggaacaacaacctttgctgatttctcatctgcatctgcgataacagagataacctttgcagggctaagtgcgttctggataagtattgccggattctcatcccatgtgatgatatcgattttctcaccgcgaagctcatttacgatagcatttactctggcaccattcatacctacacatgctcctacagggtctacgtttggatcatttgaccatactgcaatctttgttctgcttccggcctcacgtgaaatagcctttatctcaactatgccctctttaacctctgtaacctctgactcgaaaagtctcttcacaagctcagggtgtgttcttgaaacaagaatctttggtccctttgatgtggacttaacctcaaggatatataccttgatacgctctgtaggcttgaatacctcaccctttatctgctcactctcagtcaaaagtgcatctgccttacctaagttgatgctgacattctttccgatgtatctttgaacaacacctgtcacaacatccttttccttgctgttgtactcgtcaaatattacctttctctcctcctcgcggattttctgaaggataacattctttgcgttctgtgtagcaatacgtccgaattcctttgacttaacctcaactctcacgatatctccaagctgatagttaccgtttaccttgtgtgcatctgctaaggaaatctcctcaaccggatcctcaaccgtatctacaaccgtcttctcctggtagcatgagaaagcacatgtctcaggatctatttctacctttacattgtctgatttaccaaaatggttcttgcaggcagtaacaagagagttctcaattgcctcaagtaaagtttctttactgatgtttttctcctgctctaatatatttaacgcttctaataactcattgctcattattttttcctcctatttgtgttatcgtgcgctttaattaaaaatccaatgcctgacgtataagcgcaatgtcactcttattgaatgtagtctcattgccgtcttcatcggttattgtcactgtatccttatcataggctttaagcagaccataaaattcctttgatttgttgatagccctgtatgtgcgaatctctatttccttattcatattgcgcacatagtccttttccttcttgagaggtcttccaagccccggcgagctgacctcgaaggtgtacgaatcaggaatatagtcctctctgtcgagaatctcattcatctgccttgcaaccacttcacagtcgtcaacagttatgccaccctccttatcgatatatgctctcaggtagttcatgccgccttccttaacatactcgacatcaacaagctcaaaattcatgctgtcaagaattggttgtataaagctctctgtctttgcctcatatacacttgcctttgacattttatcacctctcttttttatacttgtaactattcataattgttccaagtggttctgaatagctgcctgatgtttataaacgtgaattgagagaggacttttgccctctctcaatctagtcaacgttgttatcataggtataatagcactatcagaaaaaaaaatcaagtttttttaaaaaagtacttgctttttttgaaactccatgatagtataatacacggttcgttggtcaagcggttaagacgccgccctctcacggcggaaacacgggttcgattcccgtacggactgctcactgatatttatttaattaaatacagcccaacccgaaagcatcgcatttatgcgatgtttttttatttttagattgttgctgacgccggacgcactcgcagcagtaaaatacaccttgcatgcgctaacgctacgctgtcaagatactgtacgaattatgctttttagactcactttgcttgttctacagtatctaaacagcttcgctagtcgcttatgcaaggtgcatttcggtgctgcgggcgcgtccggtgtctatccacgctatgataaataaacgtttcatattttatatcaatatcatgcaaaatgcccggagtacactctgcgatgcacaataccccgcataagcgactagcggtgctgtttagatgctgtagaattatgcttcacaaatagaaatgccccaccatggacggtggggcaaggcgttacgcaccacggacggtgcgtaaaagccggtttcgtcattctgcgaaactctatatgcataattcatacagcatcttaactgcaaagcgttagcgcatgcgaggtattgcgcatcacagaatgtactccgggcgccaatatttctgataattaatcatcgtatccgttaggattgttcttctgccatctccatgagtcggcacacatctccttaataccatactgtgcttcccagccgagctctctcttggcctttgatggatcacagtagcatgtagcaatatcgccaggtcttctaggctttattgtataaggaatcttaacacctgttgcagcctcgaaattctttacgatatcaagtacgctgtagccgtgtcctgttccaagattgtagatgcaaaggcctgcgttctcctcaattttctttaatgccttgacatgtccaaccgcaaggtcaactacatggatgtaatctctcacacctgttccgtcaggagtatcatagtcatctccgaatactccaagctctttgagcttgcctactgccacctgtgtgatataaggcatgaggttgtttggaataccgtttggattctcacccattgtaccactcttatgagctccgattggattgaagtaacgaagaagaataacgttccactcattatctgccttatagatgtccataagtatctgctcaagcatagactttgtccagccatatgggtttgtacactgtccctttggacactcctctgtgataggaatctgtgcaggatctccgtatactgtagctgatgaagagaaaatgatgctcttgcaaccattctgtctcatcacatcaacaagtgtaagtgttcctgcaatattattgttatagtactcccaaggctttgccacagactctcctactgctttgagtcctgcaaagtgaatacagctatctatcttttcttccttaaaaatcttatttaagatgtctctgtcaaggatatctcccttatagaactttacttctttgcctgtaagagccttaactctgtcaagtgacttctcagaagaatttgaaagattgtcaagtactacaacatcgtagcctgcatcaagaagctccacacatgtgtggcttccgatatatccggctccaccagtaactaaaattgccataataaatatctccttttcatttttgttaaatttattgtagcgcatttgctcatttttgtatagaataaaatgtagaagaaatatgtaaaaatgttgtaaaggtaggcaatatgaataataaatacaaaaattcctatatcgtaaaagaaaaagagcttgtatctctgtccgtatataacgtaggcttccagagctgtgatagcctgtatcagtggggtcccggtatcagagaccattatctgattcactatatcataagcggtaaaggccgctacactgtaaatggcagtgttcacacattaactcccggtgatgcgtttctcgtatatccaaataccgaagtgatttatcaggctgatgcagaagatccttgggaatatacctgggtaggctttaccggcagcgatgctgcaaccattttaagagccactgatttcacaaaagcgcatccatacatacacagtgtatcgaacggaaacgaaatcaaaagacagctcatgcatatatacgacgccagaggcacagaatttgaaaatgcactcgaaatgaccgggcgactctacaccaccctcgctctttttgtcagcgccgccacatcaaagccaccgcaaaacagcgcaaactcctatgtacaaaagggcatcgaatacatctccgccaactattcataccctatcaccgttgaggatattgcatcatatataggcttaagccgaagtcacctgttccgttccttccagagcatccttggtgtatctccaaaggaatatctgaccgatttcagaatcaaacaggcatgctatctgcttaaacactcctcattgtccatcacagcaatagcaggctctatagggtttgataacagcctttatttttcaaagacctttcacaaaataaaaggcctttcgcctaaggagtatcgcagtaaatataaaaaagctcaagaataaaaaagctgccgggcttcatgtgaagcccggcagcttttttcatatatctctttatgctaaactaagcaagcttagatttagcaacctctactaatttagcaaatcctgctgcatctgtaacagccatatcagctaataccttacggttaaggtcaacgtttgctaactttaagccgtgcatgaactggctgtatgaaagtccgttgagacgagctgctgcgttgatacgagcaatccataactgacggaactgtctctttctctctttacgtccagcgtatgagcttgtaagtgctctcataactgactgctttgctactctatactgcttagatctagcgcctctataaccctttgctaactttaatgttctgttatgtcttttcttagcgcctaaaccgcctttaactcttgccatttgttgattcctccttaactaatactaccgattacatgtatggtaaaatcttcttcatattcttaacatttgtctcatctgtcattgttgcttttctgagatttctctttgtctttgttgttttcttagttaagatatgtctcttgtaggctttatttctttttaactttcctgttcctgtaactttgaaacgttttgcagctgctctgcttgttttcatttttggcattgtgtgttcctccttaaattgttatctcttttctgccagcaccataccgatgcttcttccttcaacctttggtgctttctccactaccgctacatctgaaagattctccgctatatcatcaaggatatgtttgcttgcattcatatgagccatctcacgtcctctgaatctgagtgtgatctttaccttatttccttttgcaagaaatttctttgcagcattcatcttggtattcaagtcgttagcctcaatgttaggtgagagacgaatctctttcaattcaacggtcttctgctttttctttgcatccttttccttacgggcctgctcataacgatacttaccataatcaatcaccttacatacaggtggctttgcatttggtgctatctttactaaatcaagtcctgcctcgtctgcaatcttttgagcttctcttgaagaaacaattcctaactgctctccatccgctccaatcagtcgaacttctctgtctctgatctgttcattaatcattaattcgctaatggtcttgtacctccataaaaaatagtggataggcagactatccactatacaatcttcaacacaaatgtttgaaaatattaacgctaagtcgcgccattgcgcttaggtgagagtggatactctactttgttttcatacaactactagaatatagcacagacaatttctgttgtcaacacttttatctaaatttctataatcccaaaaatgaatttctaaattccaccgcccaatagggtgatggaatttactctcgcacagtagatatttactctttcatacaatcatgttatggttatgactccttctgacagcagtagaaggagaatcattatgagtaaatatataccaggaaaccagaaacaccttactttaaatgatcgtatctatattgaaaatgaactggcaaaagggactccctttaaagacattgcagcatttctatgtaaagatccaacaactatatctaaagaagtccgtgctcatcggctttcagattggtatcacaaaggtactttttataacgcaaagaacttttgcattcatcgttaccattgtcaaaagaccaatgcctgtggaaaaatccttctctgtggcattaaatgtgcctcatgtcctacatgtaatcaaacctgcaaggactttgaaaaagaacgatgtaaacgattggacaaagcgccatatgtttgcaatggctgcacgaaaaagataaatcactgcacgattgcacataaatactattacaacggccgtgctgctgacagaaaatatcgtgaactgctgatatcttctcgttctggaataaatatgaccaagcaccagctccatcagaaagaccagatcatatctccattaattgagcaggggcaatccccttatcaaatccttacaaatcacccggaactggatatgtctgtccgttctatgtacacatacattgacaaaggactcttcacagcaagaaatattgatttgaaaagacaggcaaaattcaaaccacgaaagtgtcataaaacacaaatcactgatcgttctgtttttacacacagaacctactctgacttttgttcattagacctgtcgtcttttgtggaaatggatacagtccattcctcaagagaatcaaacaagactctcctgacactgttttttacgaaagaaaagctatttcttgcctttttacttaaccgatgtaccaaaggtgctgtaagacttacctttgaccgtttagagaagcgcctgggcacatatgaatttatatccgtttttgaaaatatattgactgatagaggttccgaattcggagatccggtaagccttgagacaggcattcatggaatccagagaagcagcatctactattgtgatccaatgcgcagcggacaaaaaggcgctatagaacaagcacacacaatgcttcgtatggttttaccgaaaggaacttcttttgaattcttaacacaatgggatgtgaatctcatcgtaaaccacatcaactccactccgcgagaaatcctcagtggaaggacaccatatgaagttgcattagaaacgcttggtgaagatatcttaaaagcatttcagcttaagccgattgaaccggataaggttaatctgacgcctaagctgatacgctttaaccattaataaaactaatcgaaatctgctgtcagactggatgtaaatttttcacatttttaagatgcggctggtggaatttagtctagcacaccgaattccagtagcctatttagcatgtctagaaatcgagaaaatttcgataagtaacattaattatagcagaaaacgagagatttagtccaaaaatttcttgttaaaccagcaaaatttaaatcacgatggaatttactcttgcactggaatttactttttcaagtcagcaatttctataatctaatatgtaccaagaatcttaagggcaattgcctcttcccttatgcctcttaacgcattctgcaccgctgtatctgtaaaacgtccttcaaaatcaacaaagaacctgtactcccacgccttatcagatatcggacgagactggatatttaacatattgattccattgtatataaagtgtgccagcatatgatatagtgcaccactcttgtgaggtgtctcaaagcatatgcttatcctgtccgcatctctgcggcatacccttttagccgacacaattataaaccttgttgcattgtttttattgttctgtatgcggctctcaagcacctgaagcccgtatatatcagccgagatatggctagctatgccagcctgtgtgatatctccgtcatcctttaccttctttgcagaaaaagctgtattcctgacagccacctggttaatatccttatgctcatcaaaaaaatctgagcactgcataagcgcctgtggatgtgaatacacagtccttatatcagaaatctttgcacccggaagtcccatcagactgtggtcgatgcgtataatctgctccccaactatataattgtcgtattcaacaagcagatcatagttttcagatacaataccggctgaagaattctctatcggaagcactgcataatcagcctttccgcatttgatatcctccatggcatccttccaggaatccacgttgtagccattacagttctcgccaaagtatgtcttcatggcaagctgtgaatatgcaccctcaactccctgaaacacaatccgtgcattggaaaaatccaggctgtctacctcagtaaagttttccttctccactatgccatgctcagtcataagctgatactgcttctttctactggtcgacataatctgttcaaaaagctcaactataccgtgcttcaaaaactcatcatctgcaagagacgataatttctcaagcttttcatcctctctcgtcttgtcaaagacctttttgccggtggttatcttatactcggcaacgtgctttgagatatccattctttccttatataatctgactatttcactgtctatctcatcgatagactctctcaatttcattaaatcttccattattgtctcctaaaaaagatataataaaatattattacaaattttatagaaaggcaagtaatccttgaaagatttatcatatatagatataatttagttaatatctaagcataaatatcaaataccctcgggagaattacatgaaaaaatatctaaaaataattattccactaattttaatatgcatcacaggccttgttatataccattttgtatcaaaggtaaagcttaattcatcctatgtaaatggtaatactgcaggtaatctgtacaatgccgggctcttctgtgaaagtgacggtgaagtatttttctcaaatacaaacgacaacggcaggctgtatgccatgaatattgacggcagcaatatacataaactgagcaatgacacagccatgtacataaacgcagataaaaactatgtctattacgtaagaaacaacaatcagaaaatcacaagtcagaccttcttttcatatgacaggaacagtctctgccgtataaaaagaaatggccacggctccaccgtgctggatcctgacccatgcatctatgcatccctgataggcaactacatatattatctgcactatgacacacaaacagctacctctctataccgcatcagaatagatggagaagaaaaaaagaaaataaaaaatcactatctgtttacctgcaacacatcagaccggtatttttattataataatccaaaaaacggacagctatacagatatgacactgcttcacagagtgaagccttattctacgactgcaactgctacaagccggttgtgctggatgacacaaatgtatactacatggatgtaaatcgtgacaatgcgattgtccatgtcaatatcaacaatccaaatcctgtagttttaacggaggccaatattgagcattacaatgtatatggcagtctgatattctatcagcgcggtggtgataatccggcactgtgtgttgtaaaaaatgacggcaccggctttaaagagcttgctaagggtgagttttgcaacataaacgtaacatcacagtatgtgtatttcacagattttgtctcgaacaaagagtactgtacatccacacagaatccggatacaataaaggctttacagccataacagataatttcattaaaaagaacacgcatgattaatcaactcatgcgtgttttttattaattcatataaaattcaaatcttgatctgtatatatcactgcactttccggtattctggtctatcgcaataacagaaagcacattatttccctcaggaacaggtattggagctgtatactctgttgatgcagcactcggatctgacgaatcccaggtatagtataccttgcaattttcaggtactgtgattgtaatgtctgtctgtgcaccaaatgtacctccgtcagggtctatctccggtgcatccggtgcctcaaactcgatttcatacttggcagatgccacctcgcttttgattcctctgtcatcaaccgcaacagctgttatctcatatgtaccttccttgtccagggtgatcgggctataatatctttctcctctggtcaaaggatcatccgaatcatatgaatagtatattttggtatcgctgtctgcatctatagaaagctcaatagtctctccatacttgccactgctcttgctaaactgcggtttagatacagtataatccgcaaaaagctttaaaacagatgcctccttagcactctcacgcagcgcaacaattgcatcataatccttttttgattcataaatcgagataagctgcttataagcctctttgctctttggatcaatattgataatttcctgatacagcacaagagcggcatcataatccttcttcgacatatatatatcagccaaagcaaatctgacatctgtattatccgaatcaatcgacaaagccttctcataataagaaaccgcggaatttatatttcccgccgaataagctgcctttgcctgcttcacctgataatcaaatgaattgtcatgtgatctgcttacattacgtgtaatagctgcaataagtattacaattgctacagcgcacactacagctgatataataattatcttcttctgctgcgctctctttgccctctgtccgtcagactgcggcttctcacacggttgtttcgtctgagactgctgctcacctgtctgatcctgtctcacttgctgctttacagactgtgacattctgtccgttttttgtccgttccactgaccggcactatgaagctgttccctcaccggctcatcaaacctgattgtcctatcagacacaggctttgcagtcttttgtccatcagttcgcctgtcatcatttccaaccagattatcaagataatcatcaaattcgttgtaatcaggcactatctgaaccggatgcccacagacatcacagtacagactgcccgccttcaattcattaccacaattggcacatctcatacatctaatcctcttacttattgtctaattatctaattatctcttcatagcctcaacacaattgctcatgagcatcgcaattgtcataggacctacaccgcccggtacaggtgtgatatgtgacgctttagacacaacagaatcaaaatccacatcaccacacagcttattttcagcatttctgtggattccaacatcaatgacaaccgcaccatccttcacatatgaagcatctataaacttaggctttcctattgccactataagtatatcagcatttttacatacatcttttaaatcctttgtatgtgaatgacataccgtaacagttgcattctccctaagcatgagaagtgacataggcttgccgactatattacttctgccaaccacaacacagcttttaccatcaatatctatattgcttctctttaaaagctgaatgataccggccggagtacacggcaaaaaaccaggctttcctataaccatcgctccaacactctgtggactgaagccatcaacatcctttttgggatcaatagcatcaataaccttgtcctcatcgatatgctttggcagtggaagctgacagagaataccatttacagaagcatcagcattgagcttttcgataagttttaatatctcatcctccgtagtctcctctgcaagttcatacgaaagcgatttgattccgacatactcacacgcctttttcttgttgcgaacatacactgatgatgcagggtcatttccgacctgaatcaccgcaaggcagccctcgataccttttttcttaagctctgtcacttcttccttaagctcatccttaatctgtgttgaaattaattttccgtctattagattagccatatttcctcctagaataatcctgtgatcacaccattgtcatccacatcaatgccgtatgcagccggcttctttgaaagtcccggcatagtcataatagaaccgtttactgctacaacaaagcctgcacctgctgacgcataaacctcacgtacgttgattttaaagccgctcggtctgccaagcttcttagcatcatcagaaagcgaatactgtgtctttgccatacatacagggaaatctcccattccaaggtctgtaattctcttaagttctctctctgctgccggagaatatgtaacaccatctgctccatatatttcttttgcaacagtttcaatcttttccttaagtgacaggctatcatcatagagcaccttaaaattgctttccttgtgctcgattgtttcaagtaccttgttggcaaggtcaattccgccttcgccacccttctcccatacctctgagagtgcaaattcacagcctctttccttacagaactgctctacaaaatcagtctcagccttggtgtctgtgacaaatgaatttaatgtgacaactacaggcacaccaaacttgtgaagattctcaatatgcttctcaagatttacgattccagccttaagtgcatcaagattctctgatgaaagctcatccttcggcacgccgccattatattttaatgctctgattgttgcaacaagtacaactgcatccggcttaagtcctgccatacggcacttgatatcaaagaacttctctgcgccaaggtctgcgccaaagcctgcctcagtgataacatagtctgcaagctttaatgctgtctttgtggcacggacactgttacagccatgtgctatattggcaaaaggtccaccgtgaactattgccggtgtatgctcaagtgtctggataaggttcggctttaaggcatcctttaagagagctgccatagagcctgtagcctgaagatcatcggctgtgacaggctttccgtcaaaggtgtatgccacgataattctgccaaggcgcttctttaaatctgccatatcatcggccagacagagtattgccataatttcagatgctacagtgatgacaaaatgatcttctctgaccattccgtccatcttgcttccaagaccaacaacgatatttctaaggacacggtcattcatatccatacatctcttccatacaatctggcgtgggtcgataccaagctcgtttccctgctggatatgattgtcaagaagtgccgcaagcagattgttcgcagatgtaattgcatgaaaatctcctgtaaaatgaagatttaaatcctccattgggacaacctgtgcatatccgccaccggctgctcctcccttgataccaaagcaaggtccaagtgacggctcacgaagtgcgataagtgctttctttcccaggcgtccaaatgcctctccaagacctacgcttgtggttgtctttccctctcctgcaggagtcgggtttatagctgtaacaagtatgagctttccgtcaggatttttctttgtgcgattgataagctcatcagaaatctttgccttatactttccataaagctctaagtcatcctcttcaatccctatagatgctgctacatccttgattggaagcattgtagcttcctgtgcgatctgaatatctgttttcatttttctttgctcctttgtgttaattattctctaatatagtatctaattcctctttagtcaccagaaccttgcggggctttgtcccctcctcaggtcccactacaccggcttcttcgagctgatccatgatgcgggcagccctattaaagccaattttaaggtatctttgaagcattccgattgaagcccgttccttatctgtgataattgacgctgcctccgcaaagtaagagtccctgccatcatccgtgttttccacatctgaaatagtaactgttgtatttgtcgtatcattcgacaggctctccatcttttgtgccacatcattactgtactgtgcattctcattattttcaataataaatttcacaatatcggaaacttctttatctgaaacgaatgcgccctgtactcgaaggggcttcggaacaccctgtgggtcaaataacatatctccttttccaaggagcttttccgcaccattcatatcaagtatggtacgactgtcaacaccgcttgtaaccgcaaatgcgatacggcttggcatattcgccttgatgagacctgtaataacattaacagaaggcctctgtgtagctataatcagatgtataccggctgctctcgcaagctgtgccagcctgcatattgcctcctctacatcctttgatgcaaccatcataagatctgcaagctcgtccactataatgacaatttgtggcatctttggcggtttttctgtatccttgccatccattgcatcaatcatggcattgtaaccgtttatttccctgacaccgctgtttgcaaacttctcgtatcggtctgtcatctctgaaaccgcccagtttaatgctcctgcagcttttttaggatctgtaacaaccggaatcatcagatgaggtatgccattgtatacactaagctcaaccaccttcgggtcaatcataatcagctttacctcatccggctttgccttgtatagtatactcatgataattgtattgatacaaactgacttacctgagccggtagcacctgcaattaaaagatgtggcatttttgcgatatccgtaaccttaaccttgcctgcaatatcttttcccactgcaaaggtaatctttgatttggcatttttaaattcttcagactccacaagctccctgaaggaaacagcaacactctggctgtttggcacttcgatgcccacagcggcttttcccggaataggagcctcgattcgtatatccgcggctgccagattaagctttatatcatctgccagattcacaatctttgataccttcactccaagctccggtgtgatttcaaaccttgtaacagcaggaccgcagcttatattattcaccttcgcattcaccccaaacacattaagagtctgttcaagctttgccgccgtctcacgcagatgagcctgcgaatcaccggttttccccctgtcaggagccttaagcagatcaacagtcggaaatacatacggcttctgctggattgcattttctgcgtcatttaccgctatctgttcgctgactttttcaacctctttggcgagctcatccttgtctgatttgacctttttcttacctgactctgctgctggtggttttgtcattaccgcatctgcaaccggagctgacaattttgattgcagctcattatctttttgtatgtcaaaatcatcagatatatcaggctccacgcagcccgatataggtatctgcgacacatggcttgcagctgctgcacccgagccgtccggtttcatgccattaatctgctgcagggtctttctgccaagctcatctgcaccatcactatcggctgtgccacccaaaaccgaaacaggctccgatgccacaccaaagtccggtgtttgcactatttcacctgcattccctgatgtaaggcttgtcgtctttttctcctttattgcaggtgaactcgggtaattctctatagttatctcaccaagcgcatctgtagcagctgcaccttgtccaaatatccccacatgcgctgtatcactacctgccatgcctgaatccagcgcgttttcactgccatcaatttttgtatcaagtgacacgcccgttatcttattgtccatccttcggccggcacgcttactccttctgccaccttttgcagcctcctttatgtcactgtctgtatcatctgaagctaaaccctctcttgtctgacgctctcttgacttatactgccgatactcctgatatctctcattattctcacgcgctgactcgtatacctttcggccgccgtttctcatacccttcatgaatgatttaccggtaatgagcacaagacagataatcatcacaactattgtcaccacgtatgcacctataattcctaccgccggaactaaaatgcagcctataagagcacctataaagccaccacctgaatgcctttcaacactgtcaatgtatgactgcaccggtgaaaccgcgaattcaccatacactgccaggtacataaacacacatataaaccatatgaaaactatggtcataacaagcttcatgatagcatatgaattgcccttattggacacagcaaaaaagctgcccaccagaagcacaagcggaaaaatatatgccaccattccaaatacaccaaaaaggaaaccgcttactgcgtttcccaaatgaccgcctattccaaaattgcttataaataaaaggattgaaacagctactactatccagagaaatatttcctttttaaaggcctgctgcctctctatctgagccattctctccttttttgtctgtctttttgctgaggatttcttcctcgttgccatgtaactaacctccgtgttttgatttacagagtatataataacatatttcttctgttctgtgtaaattttctaaagtaatttttcgattttgtgattaaagggtcaaaaggtatcatcgatgcatgcttgaatgcaattcaatgtataccttattgacccgcactacaccgagaaagtagcaatttgctgcggggacgcagcaaattagcggattcgaggtggagtcagattacgggaatgcgtagcatgtagtaatctgattaatcataaatgaggtgcaaaataccccgccatgaatggcggggcaaaatgttatgcaaaaaccacaatttcaccaaaatattttattcaccaataaggtaattgtataatccctcatatttgaatttcgaagcattccaagagaaatcattagccatgcccctgtccacaatctggttccactcacgcttcttatcgaagaagatgtgcttagaataattgatgactgcaagcatctcatcggcattgtagtttgagaacgagaagccatctcctgaattctcatactcattgtaaggcttaaccgtatccttgagacctcctgtctcacgaacaatcggaacggtaccgtagcggaatgaaataagctgtgtcagaccgcaaggctcaaacctggacggcatcaagaatgcatcagcagccgcatagagcttgtgagccagatcatcagagtaacatatatttgccgaaactctgtcagggtatttccatgcatagtgtctgaacatattctcgtactgaggatctcctgtaccgataacaacaagctgtgtgaaatcgtccacgataccttcaatcacatgattgataaggtcaagacctttctggtctgtaagtcttgaaatgagacctatcatatacttcttcttgtcaaccgcaaggccaagatcctgctgaagctttgtcttgttgttgaacttcttctttctgaaatcggaagcattgtaattgcaatagattctgccatcagtctgtgggtcataagcattgtaatcaataccgtttacgataccctgcatgtcaaaatgtctggcacttaagagtccgttcaatccctcaccatagtactccgtctgaatctcgtttgcatatgtatcactgacagtggtgatatagtcagcatatacaagaccacccttaagcatatttgcgtccttcttgaactcaagcttgtccggtgtgaacagattgtctgtaagaccagaaacaccctgtacccactccctgtcccatattccctggaacttaagattgtggatagtgataattgtcttgataccccagaagaatggatttgcggcaaactcattctttaagtatacaggcagaagacctgtctgccagtcatgacagtgtataatatccggcttaaaatcaataagcgggagcattgaaagtacagccttgtcaaagaatgtatacttctcaatctcaaacttagtgtcagaagtatatggagaaaatcctgtaaaaaactcctgattgtcaataaagtaatatgtaatgccgtcctgctcatatttgagcactccgacatacttgtcctgcacgtatggacctgagctcatgtaaaaatgggtaacatactcaaaattattgcgatactgctccggtatacagctataatcaggtattacaacccttacatcccaatagttcttgtcaaactctttaggaagtgcaccgcacacatctgcaagacctcctgtttttataaatggtacacactctgaagctacaaatagaatctttttcatattctcctcccgctaaaacccgtgatatataatatttagtttactcttcccaattgtggtatacttcctggacgtcgtcatcatcgtcaagaaggtctaagatacggccgatatttgtgatgtcagcttcatctgtcagtgtgacatatgtctgtggaatcattgtaacctctgccgaagccattgtgatgcctgcctcctcaagagcagccctgactgcatcaaaatcagcaggtgcagttgtgatttcgtagctgtcatcctcatcggcgaaatcctcagcgcctgcatcgagtgcctgcatcataaggtcatctgcatccatatcgcactcttccttgtcgatgatgatctgacccttctcgtcaaacatgtatgatacacagccctgtgtaccgatgcttccctgtccctttgtaaaggcattacggacattggccgctgtacggttcttattgtctgtaagacactttacgataatagctgtgcctgatggtccatagccctcatatgtagctgtctcatagtttacactgttgccgtctcctgctgcctttttgatacctctttcgattgtatcgtttggcatattgttggcctttgccttggcaactacctgtgcaagcttgaagttattggcaggatccggtcctccctctttaactgcaactgcgagctctctaccgatcattgtaaagattttgccctttgcagcatcatttttctctttcttatgcttgatattcgcaaatttagaatgtcctgacataatttgtatcctcttttctacttttaaaaataatccataccttataatatcattttttctcttccggcgcaagtttcttaatcattacctgcttaatcaccttatcctcgacgctcataacagaaaatctgtagccatatgcgctaatcacagtcttatccccctcctccggaatcttatccgaaagcgatatgataaaaccgttaagcgtctcgtaggcatcatcatcaacaggcagtgacagcgcctccttcacatcggaaaactcagtcatgccgtccattataaatgtctcgtcatcattctttctgatgtagttttcttcctcatcgtgctcatcctcgatatttccgacaagctcctcgagtatatcctccatcgcgataagtccagatatctgtccgtactcatccacaaccatcgcaagatgactctttttagactgcatctttttaaacagatcgttgatatttacagtctctggtatgaagtccaccggccggataagcccttctatgtccttgatactgctgcggtaaacctcatttttttcaaaaaatgtaaaagcatccttgatatgtaagactccgatgatactgtcaacatcattctcatagaccggaaagcgagatttgccggtatctatgataaattcgattgcatcaataaaggacatactgccgtcgaggcttacgatatttttgcggtgagtcatgatatcttttacttccttatcatcaaactcaaatacattgtgtatcagctctgcctcagatgcaaggattgttccctgctcatgcccctccctgaccatggaaataatttcttcctctgtgacatcatcatttccaagtattccatcgaaagtctttttgttgtttttcattccataaagcaatactccaatacacaaaagaagtatcactacaagtattgataaaattataattgcatataacataatgttttattatcctatgtaataagttctaagctgatttcaagcgccctgtctattttaagcaatgtgtcctcatcaagatggcacaccttatccttaagcctttttttgtcgattgtgcgaagctgttctaaaagcacaaccgaatcctttgcaagcgcatactccttgcaggcaagctccacatgggtgggcagctttgctttatgcatctgcgaggttattgctgcgcagattaccgtcgggctgtgtctgtttccgacatcattttgtattataaggacaggtcttatcccgccctgctctgagcctacaacaggccttaaatcagcgtaataaatatctcctctttgaataatcatacacgaatacactccatattatggtatacaaaaagtatctccagatttttcgagtgtattcttaaaagttacacttttttagtttttgtggtagattcttggaacacgcggtgtgataagacatgcaaactcatagttgaatctgcctgaaagctcacctaactgctccatagtgattgtctcatccccgtctttaccgagcagagtaactgcatcgcctattttcacgtcaggtatgtctgtcacatcaaccataaactgatccatacagactctgccgcatataggtgctttttttccttttatgagaacccagcccttgtttgaaagtcctcttgaatatccatcaccatatcccaccgggacagttgctatcatcataggatgctctaccgtaaatgtgccgccgtagcttatgtgcctgcccggctcaagctcctttacataagcaactctgctgtgcagcgacataacaggctttagggagattttactcttgtctacctcctctgacggccacagaccatagagtgtgatgcctgctcttaccatatccatattgcactcagggatttctactattcccgcactgtttgagcagtgcttaatcgggatctcgactcctcttgcctcaacaagagctatcatcctcttaaaaagatcaaactgctcaaaggcaggctcctttgacagctcatctgcccttgcaaagtgagtgaatattccctctatcataatattcggcagcttagcaatctgtgcaataatatctgcactttcctctgtcacctgaaagcctatacggcacatgccggtatctatcttgatatgtatcttacaggttttattcttagcgacagcgatacgcgatagctccttagctgtctcatatgtacataccgccgggcgcacatcgttgtccactatctcctcaaactgctccgggaagctgagtcctaaaataagtatcggctttttcctgcctgccgcaataagctccattgcctcgttgcttgtagcaacggcatagccccacagatacggaagcggctccagtacctctgaaacagcctcagcgccatgaccgtaaccatcagcctttacgactgctgccatcattgtccccggctttagcttattatgcatcgactccatattatataaaattgcatccagatctatatctgctctgattctgttaattgccatttttttccaccttaatccaaactttatctaatccatcaataatatcacttgctatcataccataagagccggtattgtcaaataccatatcaccggcaagtccatgaataaatgcaccgtatgccgcggcctttttcgtgtcacgccactgtaccagaagacctcccacgataccgcttagcacatctccgcttccggctgttgccataccgcagttgccggacagattgataaacttttcgccatcagccgctgcgataatcgtacgaaaatccttaagcacacaagtcacattgtacaagcctgcaaactctcctgccacaccgatgatatcctcctgtatattagcaatgctctttttcataagtctggacatctcgcccaggtgcggagtcacgatgacaggcattttatgcttattaagtaaagtcatgttgtctgatatgatattaagcgcatccgcatcaatcacaagaggtatctctgctgtttttagtactgtttcaactaacattttggcattatcagactttgaaagacctggacctatcaccactgcatctgcccactcaagctctgtctcaagcgctttagctgacgcgatatcagtacaaagcagtgcttccggcaaagcacattggattattgagcggttgcactccggcgttataattttcacaagccctgctccgcttttgtatgcagcctttgccgaaagcaccgcggcaccggccatattgcggcttcctgctataactaacagttttccgaaagttcccttgttggagtgtgccggtctgttatcaagcttgtttaaatcagactcatcaagagcccttactgatggcagattaccacaaaagctgtggtcatctatgcctataggcaccaccttaaccagaccgcaataatcacagcccggccacaggagaaggcccgtcttcttataagaaaaagtatatgtgaaatctgctttaaaagtgcatcccatcacatgtcctttatcagaatccactcccgacggcacgtcgaccgccaccctgtaagcatctgtcttgttaacgtatgaaatcacatctgctaaagagccttctatggctcgcttaagccctgtgccaaacagtgcatctattattacgtcacttttacacacacactcaatatcagagaccaccttaaagccataccttgcgtatatatttttctgcagctcaaagagctcgcttcctgcctcatctgtgccaaaagcatagtacaccatgcatctgtatccggcctgatttaaaagtcttgctatcgcgataccgtctcctgcattattgcctctgccgcatatcacggcaaactcctttgatttatcaaaacatgcaacaagctcccggacaacaccggccgcagcctgctccatcagcaccaccgaaggaaccaaaaagacctgtgatgttgtatcgtccagaagcttcatttcattacctgtaacaatatattccaatatcaattccccttattctcattgtttgcattatcagtatttgcattattggcattgaaaaccataggatcgtcatattcaatatcaaaaagatctaaaacctcagcgccaaaaatatcatgaagatacgaataaatctccctgttgttaatatctctgttctgttttctgattacatttttcttgagttcaactcttatatttgcaatccagtcgtcaatttcttttgattccagtttatttttctcgattttttcactgaagtaatccatcgacaaaagcatcagcctgtcatttacagcttttatattctcctgaatttcaataagctctccctcaatgttgtcagctttctcatttatctcatctataagctgcttatccttgtcacgattttcatcgccgtcatctcccatgttggcaacaatattagacataattttcgacttaagcttttttaaattcttaagctcattgttgtactttccctgcagctttaacagctcatccaattctttttcggtggctgatatttcgtcagtcttaccatgaatggcaaaaagtctgtgccacttctggtctaaaaccagtaaaggcaccttttttccttttaatgcagcctcaaaatcttttttatcattcataagactcaccttctatttatttttggagtttttaacaatattatagctgagctgcataaggctgtcagacagatgaacactctccacaaccacatctttatttggaatttcaagatccacatgtgcaaaattccatatagcccttattcctaaatccacaagctttgacgcaatagagtcagcctttgactttggcatggtgagcgccgcaatatccaccctgtgtgttctgcaatactcatccagctcacttagcataaggattggaatacctcgcacactctttcctgaaagctcaggatttacgtcaaaaagcgctgttatgacaaagccaagcttttcaaactttacataattggcgagtgcctggcccagattgcctgcaccgatgataattattctatgctctgtgttaagccccattatctttccgatttcctcgtagagaaactgaacattgtatccgtatccctgctgtccaaagccaccgaaattattgagatcctgtctgatttgtgaagctgtcactttcattctgtgactcagatcatttgatgaaatacgctccactccctcatccaaaagctctccgagatatctatagtatcgtggcagtcttctgataaccgcctgtgatatttctttactcaagtcttattcctccaatcatcaggatatcatttctcttttaaagacaaaaacccaagattaattataattttttgaaggtcatctgtcaatgtgttaagaatttaacattcaaaaaattcataattatccccgggttatatcttattctaaggctaaaaaccaaatttcagattaaattgtcttctcaagctcctctctgattgccttgatgaagccttcgctgtttaaaacagtaggattttcaattgttgtgatgagtgcgagatcctttgtcatctttccgctctcaatagtctttatgcaggctgcctcaagcttgtctgcaaactcagaaagtgccggaatcttgtcaagctctcctctttttctgagtgctcctgtccatgcaaaaatagtagctacagagtttgttgaagtctcctcaccctttaagtgcttgtaatagtgtctctgtactgttccgtgtgctgcctcatactcatagtatccgtgaggggatacaagcactgatgtcatcatggcaagtgagccgaatgcagatgagatcatgtcactcattacatctccgtcgtagttcttgcatgcccagataaatccaccctcagatttcattactctggcaactgcatcatcaataagtgtgtagaaatatgtaattccagccttctcaaaagcatccttatactgtgcatcaaagatttcctggaagatatccttgaaggtatggtcatacttctttgagatggtatcctttgtggcaaaccataaatcctgctttgtatcaagtgcatacttaaagcagctatgtgcaaagctctcgattgaatcatccaggttatgctgtccctgaataactcctgcgcccttaaactcatgtattaattctctggtctcagttccgtcttctgctgtaaatacaagctcagcctttccgggaccggctaccttcatctctgttgccttgtatacatcaccatatgcatgacgagcgattgtaattggtttaacccatgtctttacgtttggctctataccctttacaacgattggtgctctgaacactgttccgtcaagcatggctcttattgtgccgttagggctcttccacatctcctttaaattgtactctgtcattctggctgcgtttggtgtgattgtcgcacattttactgcgacaccgtatttcatggttgcctttgctgattcaacggtcacctgatcatctgtacgatttcgctcctctaagcccagatcataatactctgtctttaaatcgataaaaggtattaaaagctcatcctttatcatctgccagagaattctggtcatctcgtctccgtccatctctacaaggggtgttgtcatcgtaatcttgctcattcttaaatctcctttacttaataaggttctcccaaccaaggtgttccatatttttctttgaattgtttatatgctctctggcgcatttttctgccagcagtgcgtcatgattcttaattgcctcgcatatctgtttatgctcgtgagtggagtttttggctctttttgtctcgccgagtgtcacctttctcactctgccgacatactcatgatagtcctttaataccctcataagttccttgcttccgccggcctcatacagcagttcatgaaacctattgtccagctcaagaagcttctttgcattgccctttttctcatgaaactccgtgagataaatattctcctccatggccgccatgagctcgtccgatatcctcgttgcagcccatctggcacaaagtccctcaagcagagcccttatctcgtatatatccctgatatcgtccgtggaaacaccctccacgaatgctcccttattggggatgatagacacaagtccctcaagctcaagctgacgcagtgcctccctcacgggagtcctgctcactccaagctcatcaccgatattcttttccttaagctcatcgccctttgcaaatgttcctgcaagtataccatccctgatatgattgtatactctggcactcaggctgtaattatcatgtgacatgtaataatctacctcactataatactatattaagctttttacagcaatcagtaatttgaactacaagctcattatctgtgatggtagtcacacggccctcgtcgtactgctcatctacccattcctttatcatggtcacaagctttgagttcttatctacttttctgtcatccggcaggcggtagtaggtgtttatccacagcgctattcctgcaagtcctgatgtattggacactgctacaagaggtggtctgtttaagaatttacctgtatcgaatatgttgtaaatttcctcatttttgagaagtccgtcagcatggattccggctctcgtcacattgaagtttctgccgacaaaaggtgtacggctcggctgcacatatccaagctccttctcaaagtactctgacaactctgtgataaccgttgtatccattccatcgagtgtgcctttaagctgtgcatactcaaataccatagcctcaagtggtgtgtttccggttctctctccgataccaaacagtgaacagttgacaccgcttgctccgtagagccatgccgtagtcgaattgtttactgccttgtaaaagtcattgtgtccatgccactcaatctgtgatgaaggcacacctgcatgtgtgttaagtccgtatatgatacccggaacgcttcgaggtataactgctcccgggaagtttactccatatcccattgtatcacatgcacgcaccttaatcggaatcttgtactcctcctgcagcttcatgagctcaacacagaatggaataacaaaaccatatatatcagaacgtgtgatatcctccagatggcacctagggcttattcctgtctcaagacactccctgatgactgacagatacatattcattacctcgcgtctggtcatcttcatcttatagaaaatatgataatccgaacagcttacaagtataccggtttccttgagtcctatatcctttacaagctcaaagtcctttttgctggcacgaatccacgatgtaacctccgggaacttatatcctctctcgagacacttgtaaacagcgtccctgtcctttttgctgtagaggaaaaactcgctctgtctgattattcccttagggccaccaagcttatgtaaataatcataaatggtaacaatctgctccgtcgtgtacggtgctctcgactgctggccatctctgaatgtagtatctgtaatccaaatgtcctccggcatattgtgaggcactattctgtcattgaatgctatcttaggaacttctgaataaggaaagagatttctaaaagtattcggctcatctacatccacgagctggtaaaaatgctcttcaagctgcagtaaatttgttttttcgttcatcaaaacttctctcatcttcacatctcctgtgcttagttttatcttttgaataattgtatacaattatactttttgtgtcaataaaaaaatttaaatcttagtgtaacactttgttatgtctatcataacctagagtgtaaataaattttattggaggtcacttatgagtgatttagcagcaacaaactgttcatgcagcaatacagataacggatgcggatgttcttcgattttatggatcatcctgttactgtgctgctgttgtggaaatggtaacggaggctctttcttcggaggaaacgactgtggaagcggcaataacagctgtatctgggctatcatcttacttttctgctgtggtggctttggctgtggcggcaacagcaataacggctgcggatgtggctgcggctgctgatttacatttttactgcgggtcttttcggcccgcagctttttacgatttttcagtattctttttttgcctgcgctgctctttttctttgagcttttcaaggactttacattcgcccttcaccctgtgctttttgatgcattcttcgtctatctcgtatacgtcgtgaccatctatgataagcatatatctttttttaataatatatgctgtaaacatgcataatgtgaatcaggtgacatattatatagaaatatattttaaaggatttttatggacgagaacagcctgtttacaccattcgatgaaataacccagacaagggagcttcagatgcttaaaaccataatcccatatatgccgcatgactcacaaaagcagatgactcttatggttcactacatatcacttatgaattcaatgagaatgatagattgtgcacctgcactatctgttgcggagactgaaagtatgtcagacagaaggctttccatgctcaatgccttaaagaaatactgcagtaaaagtgaacaggatacgatagacaatctattaaatattttttcagttttggacaatagggagatttatgacaaagcaggaatttttaaataattttgcacaaaaggaaaaaccgaaagatacaacgagcgccatgccgtttctcatggaaagtattaaggaagcaaagcgtaacggcatagaatttaccaaagaagaggtctattccatgtgcactgagctaagtaaaaacctgcctgagaaaaaccgcaggcaggttgaaaagcttttaaaaatgctatagttaatttttaaacgaatctgtatttatgcgaagtatcttgtctatcggtgcaggcgagtttcccttgccatccgtgccctcaaggtacttctcccccgcagattcaaaaatgacatacaatcttttatccacactgtcaagctcctctgagcccggcggcatctctattgtgatgtcgggtctgtttggccttgacgacagagctatgagtgatttgtagcacttgatatacgatgactcattcctgccataggaggtgctcagatatacctttcctgaggcatcaaatgtaacgccctgcactctggcaggtatcgtatatgtgctcaggcttgtgagcctgtcgtcctttttgtcataataatatgctaccatctttgacctaaaaaggatattgtgagtggctatccacagcctgcctccatagtatgttatgcacgacggcttgtttcccacatcaaacacatctaccacacctgtcgcatcgatgacctgcttggaattcgcagtggccattagagagagaaaatcatacgagatgcgctccacagttgtgtcgtaggaattgcacacccatacattttccccgtcaaaggcaattcctcccaggtgactgtttgcatccatgccaagtgtcacaaggtactctccgtcctccctgtcaaataccataagctccccgagtgagcccttgtcatcagaatagcttgtgataagcacgtattcatccgtgatacaaattccctgaggacactgtgcctcactgaaaatataattattgagaaaatcattttccttcgtctccggcatgcccggaatatctatttcatctataaaatcgtaatcgcaatccttaagcgccagtgtatgcgcttttttattactcctgtaattgtaatgctctacgctgtattcattgttaatcgtcctgacccatttggcatataccacatatccatttgctttttcgtaggtcagaacatccgccttttttgaaaaatgctcatccagataccagccatcaaatttataaccgtatttgtgtggttctcttagtcccatgaatttctgctttggtgtgatgtatccacaattattgatattgtttgccgcaccgcccagattatagtaaatatatgaaacaccatcactttctgacatattgtcaaccagtgtatttagtgatggcccggaagcaaaagaggcagcttctgcctcttttatctccgatgcaaacacatgagtattggtaaaaatcaatgtaagtaatataattaatgctattctactcttcaacttcaacaagcttgcttgccctttcttctatctgttttgcagccacatcatccggtgcctgctcatatctggcaaactcatatgagaatgtgccgcttccactcgtcattgagcgaagtgtggcattgtatccataaagctccagataaggaatatccgcaactatctcctgatatccattgtctgtcgggttcatgcccatcactcgcgcacgtctcttgttaagctcccccatcacatcacctgtatagccctcaggcaccactaccttaagagtggcaatcggctcaagaagcaccggctttgcctccataataccctttttaaaggcctgctgcgttgccaccttaaaggccatctcagatgaatcaaccggatgataagagccgtcatacagcacagcctttatacccgtcacaggataagctgcaagaggtccctttttcacggactctgcaatacccttttcaacagccgggaagaagttcttcggtacagctcctcctacaaccgtctgctcaaatacatatggcgtatccatatcaccagacggctcaaaggtcatcttgacatgtccgtactgtccgtgtccgcccgactgcttcttgtacttgtactctacgtcagattttttcctgatagtttccttaaaggctacctttggacgcataagctctatctccaccttgtacttttcaagaagctcacttgccactacctcaagctgcatatcaccgataccatatagtacagtctgtccattttcactgtcatttacactgtttaatgtcagatcctccattaacagtttctgtaaagactgggaaatcttgtcctcatcgccctttttctttgccttgtagcgcattgccacatacggctttgatatacttgttctaagatatgtaaccggcatatttctggtggaaagtgaatctgtcgtaagagtctttgcaagctttgcaagcgctccgatatcacctgcatgaagctccttcacttcctccaccttactgcctctcatcacatagagctttccgattttttcatcgcagtccctgtgataattgtaaagcacatcatctgtctttagtacgcccgaattaaccttgatcagtgaatacttaccgatgtatgggtcaactatagacttgaacacataagcgctctttgattttgcaaaatcataatcagcattatacacctcatttgtcttggtgttaataccggtacagcttctcttctcaggacttggcaggtatttcacaatatcagccataagtgtatacatgcctcttgcgagaatatttgagcccatgagcaccggtacaatagagccctcaaacacgtttgcacgaagcgcagccctgatttcatcatcagaaaactcctctccgccgaaatatctgtccatgaactcctcacttgtctcagctacagcttcaactagggcctcacgacatattcccaggttctcctttgagtactcaggcacatcaaacttatccacgcctccgctttcattccatctctttgccctctgctggatgacattgacatagcccacaaacttctcattctctctgattggcagatggaatggagctattttcttgccgtaaagctcctgcagctttagcaccacatccttgaagcttgcattgtcgatatccatgtccgtcacgaaaatcatcctcggcagcttgtatttctcgcatatctcccatgctctttttgtgcctgtctgtatgcctgccttgcctgaaaccacgatgattgcagcatctgcagccgatacagcttcttcaacctctcccacaaaatcaaaaaaaccaggagtatcgagaatatttattttgacattatcccactctatcggtacaaccgatgtatgtatagagaactgacgctttatctcttctttgtcaaaatcgctgatagtgctgccatccgctacagtgcccattctggtagtctgtcctgccagatatgccatagcttccacgagtgatgtcttgccacagccgctatggcctaaaagcacgacgtttcgaatcttctcagtagtgtaaacattcatttcaagtacctccctgacattattatagtatgtaaacattgtactaatattttatataatttacaacacttttatgcaatctgacgattatttttttattgttatattggaataaatatgccaataatttattgctttatagtgttaaattggatataatatattgtaaatattcaaaaccactatagtgcgattttgagaatgtgcgtgtggtgattctgaatagttacaataaagaattaggagatacacataaatgcattttgataaagttggctttatagggctcggtctgattggcggctcgatagccagaaaaatgaaagaaaataatccaaaggtctcaattatcgcaacagccgggcatcaacagaccatagatgatgcctttgggcttggcctgatagataataatgagcttttagagcttaactcttttaaagactgcgacgtaatctttctgtgtgcaccggtaaacaaaaatatcgaatacctcacacagcttaaggatatcataaaggatgactgtatcatcacagatgtaggcagcaccaaaacccagattcatgaaaaggtcatagagcttggtcttgagcgcaatttcatcggcggtcatcctatgaccggctctgaaaaaacgggcatactcaattcagacaagcagcttttggagaacgcctactatattatcactcctactgctgcaactactgaagaaaatcagaatgatttcaaacagtttgtactttcactgggctcaatagctctcattttagactacagggagcacgatcatgctaccgcagccatcagccacctgccacatatgattgcatactctcttgtcaatctgattgagcatattgattccgaaaaagagaccatgaaaactatcgctgccggtggcttccgcgatgtgacacgtatcgccgcaagctcccctgtcatgtgggaaaacatatgtgagtccaacaaaacacagctgctctcactcatggaccagtatgaagccaatttccataagcttcgcgaaataattgcagagggcagttctcaaaagatgattgattatttccaggattcaaagaattacagggattcactcacacttcccggtgccaaaatccgcaaggatttccacgaagtatttgtcgatattgccgatgaggcaggcggtattgcagtgcttgcaagccttttagccttcaacggcatcagcatcaagaatatcggcatcataaacaaccgtgagtttgaggagggtgtactgcgcatagagttctatgacgaagatgctcttgaatcggctatcagcgtacttaaagaaagaaactatactattcaccgcagatgatttatcctgttatatggttttaatcccaaaaacaaagagccgtaaaacgaatttgattcgttttacggctctttttataccgtccaatgcagcactgtttacagataaacagaaaccaataacactttattaatatacgctctcctcaagtacctcatagaaattctcaaaggtcttgcggcagcaataagggtctattatctcaacaccctctgccttaagccccggcaaagtaaatgacatggctacgcgatgatcgtcatacgttttaattttacaaggcttaatacgctctgccggataaatctttaagccattttcaatttcttcaaccctcacacctaattccgtcaggttttcctcgatggcgtttatcctgtcacactcctgcagacgaatatgcgaaatgccttctatccctacaggtgcatttgcaaacggtgcaatcgcagcaagtgtcagcgcctggtctgagaatgttgacaaatcccagcttccgccatgtatatgagcattctttggtggcatacacactatgccgtctgcctcgtcggaaattgtgcagcccatatccgcaagcacatcaagaaatgccacatctccctgcaagctgttctggtgcacccccatcacctttgacttaacatgtaaaagcgggctcattgcataaaaatagcatgcagccgacacatccggctctatatcatagtctaagctttcatacgccgctttcttagggataataaagctgttattctttttatcctgcatcacatcaagcccaaactgcttcatcataagacgcgtcatctcaacatatgccataccatgcgttcctgtgacattaatcgtaaagttcttttccatcactatcgccgagataagaagggcactcaaaaactggctgctcttgtctacgtttatatcaacagtatcagcatactcccctgtatttccgatggtaaaaggaaaatgatattcgttctcatcatactcaatatgggcacccagcttttcaagcgatacaagcagatccttcataggacgcttcttcatctgctcagaagacactatatggtatctgccctttgacagtccaagaagagctgtaagaaaacgtgcagcggtacctgcacttcccacatctatctcagcttcattctttggtatcctgcctccaaagcctgttattgttatttttcttttatcctcatccaccaaaaccggaaatccaagacgaatcagtgcatctataaaatgtctcgaatcatcactaaaaagacacccttttaaaacgctgcgcccgcttgcgagtgcagcgattaaaagggccctgtttgtgatactctttgagccaggtacactggttactatatcatgtggatgatttactttttttactttataaatcattgaaaatctgataaatatcaatcttgagtgcatcagtgtctgtcataccgataaacacagcaccatagtgatatactccttcttcactgtctgttcttcgtacaatctcgacaaccgcatccacaacctccttggtccaaatttggatcttggtgtcataatatgtatgtatatcaagaggtacctttgcattaaatcctataccgcttctggaaatatctgtgacatccacatgacaatacttaagtgttgtcactccgtcctcatccagccgctctaactgtaccgatacatcaatgtcaagtcttttatgtcttctcttttcttccattcactttaccccatctattatattattgactaagggaacaaattaccctcaaacaacatattagtatatatgactgatttttacaagtaaaatttattcagctgcctcatcgtccatatgcatatcgttcgttataaacatcgcatcaccaaagctgaaaaacctgtatctttcctctacagcctctttgtatgcattaaggacatgctctctgcctgctaatgctgacacaagcatgacaagtgtagactgcggcagatggaaatttgtaatcagacagtcaatcaccttaaagctgtatcccggataaataaagatatccgtccatccgctgcactcttttagcatgccgttttcatcggatgctgcctctaaggtacgagtgcttgtagtgccgacagatattattctgccgccatttttctttgcattattaatcttgtctgcagcctcctgtgacaccatgtaaaactcagaatgcatatggtgatcaagcacattatccacctttaccggtctaaacgtgccaagccccacatgtaaagtcacctctgctatatccactcccttatcctttacctgctgtaaaagttcctttgtgaaatgcagtcctgccgtaggcgcagcggccgagccgtcatactttgcatatactgtctggtagcggttcttgtcctttagctgatgtgttatatacggaggcagcggcatctgtccgagcttatcaagtatctcctcaaaaataccctcataactgaactgaatcagcctgtttccatcatcaaccacatctattacttcaccggttaaaagtccgtcaccgaatataattttcgtgcccggctttgcctttttacccggctttacaagagtctcccatacgtcattttgtctgcgctttagaagaagtatctctatctttgccatagtgccttccttcacgccaaaaagacgtgcaggaattacctttgtattgttgagcacaaggcagtcgcccggtcttaaatatttaacaatctccttgaacacatgatggctgacttctcctgtcttcttgtcaagcaccatgagtcttgagctggagcggtcctccagaggatcctgtgctatcagctcctccggaagatcataatcaaaatcttttacgtccataattttcctattcctaacactatactaacgtctaaccacgaagtgtgatacctgcagtctctttaagatgagcaagtatatcctttacaaagccctcgaccttcttagtcttaagctcctcatcctttggtgtaaatactacactgtacgccatgctcttcttattcggaggaagctgtacaccctcgtaaacatcaaacagtgtaacatctgagacataatcacaggcttccctgataccgttttcaatctgctcacatgtgatatccttgtccacaacaaaagcaaaatctctcttctcatcatcaaattttgagattggagtaaatactctgtcctttccataccactgtgaaagaactcttaagtcaagctccatcacatatgccggtactctcatgtcaagctcatcgcatatctcatatcttacctgaccgagatatccgattttttgtccgtcacagaatacctctgcggtctgatatggatgaaggaatggcttttgagccggcttgtatgtaaacttcacatcaagcgcatctgctacagtctcagccagtccctttatagtaaagaacgattcatcctcaccgaatacacctgcgcaaagtgtctctctctcatccggatactctgtaagcggaagctcctttgcgataaagatatttccaagctcaaagattcttccctccaatatacccttcttctggtttcttgctatggcataaagcatctcagaagcaagtgttgttctcataagcgagaggtcaacattgattgggtttataagcctgatagcatgcctttcaggtgcatcctccgggaatctgagcaaatcaagatcagctggtgagaagaatgagtaatgtattccctcatacgcgcctgctgcacagagcacctcttttatcttgcgctctgtctgctgtctaaggttgagtcctccgagtgtaacctgtgccgtaggcatgaatgcaggaatgacatgatcatagccatacatacggataacctcctcggccacatccggataatcctccatatcctcacgatatgcagggatcatgagtgtcagctcatcaccgcttacaaccggtgcaaagcctaaatttgtgagtattctcacgatttcctctgtaggtacctctattccaagcacaccattaacctttgcaatagaaaccttcatctcttttggctcaagcgaatttcctgtagtcacctcaacgtgagttgaagaaaccttaccacagccaagctcctccatcaggtgaagcgctctcttcatggccatggctgttgtgtactcgtttacaccctttgagtaaagtgcactcgaatcagatgactgtcccaacgcacgtgagctctttctgatattgtctcttgcaaattttgcagactcaaacattacctctgtggttccgtcgttaatctcagagtttaagccgcccatgataccggcgagcgcaactggcttctttccatcacagataaccaagttattgctgtttaactcaaattccttctcatcaagtgtaacaattttctctccatcgtttgcacgtcttactacaatctcatctccctcaaggtatgagtaatcaaaagcatgcattggctgtccgagctcttttaaaacaaagttagtgatgtctaccacatttgaaatagagcttattccgacaagtgcaagacgctttctcatccatgccggtgactcagagatttttacatcatgcacatagtgagctgtgtagcgagggcagatgtcctgtgccaggacagataccttgaaattttccttcttcacatcatctgcagtatagtcagttgcaggctccttaagctcttttcccaaaacagcagcaacctctcttgccatgccatatatacactggcagtcaggtctgtttgctgtgattgcaatatcaaaaatccagtcatcaaggccgaggataggttttacatcatctcccgccttagcatcctcaggtaaaaccaaaagtccgttgtagcctgcacccggatagaggtcttcatttaagccaagctctacgcctgaacataacattccatatgaatcatatccacgcagcttgccctgctttatctccatcacgccctctattgtaacgtgatcctttgctgtggcatatactgtggcaccgataagtgcgagaggatatttgccccctgcctttacattgtccgctccacagcagatctggaatgtgccatgtgctccggcatttacctgacatagactcaggtgtgtctcaggaatcggctcacatttttctacaaggccgactactacgtttgagatatcctttcccacctcatatgattcctcaacctcgaaaccacatgagaataatttttcctctaactcctttggtgttacatctatatctacataatcttttaaccagctaagtggtgttaacataatttttgcctcctgttatatattcaagaaaaatgaatctagttgtcatcaatctggtctaataccctaaggtctgactcgaataaaagcttgatgttgttaattccgtatttgagcattgcaatacgctcaagaccgataccaaatgcaaaaccactgtactcatttgtgtctatgccacagccctcaagcacctttttatttactacgcctgcaccaagcacctcaatccagcctgtgcccttgcataaagagcagcccttgccgtggcactggaagcagcttacatcaacctctacagacggctctgtaaatgggaagtatgaaggacgaagacgtgttgtgacattctttccgaacatcttctttacaagctggtcaagcataccctttaaatcgcagagtgtgatgcccttatctaccacaagtccctccatctgtgtgaacataggagaatgtgtcgcatcatcatccgaacggaaaaccttacccggtgaaacaaccttgataggcggcttctttgcttccataacgtgaatctgtcctgctgaggtctgtgtacgaagtaagaactcaggtgataagtagaatgtatcctgcatatcacgcgccggatgatcctttggagtatttaaagctgtaaaattatagtaatcattctcgatttcagttccctcgtaaacctcaaagcccatagatgtgaaaatctccgagagctggtcctttacctgtgttacaggatgaagattaccctttttgcttctctttgcaggcatagtgacatctattttctcgctctcatacttgcgcttaagtgcctctgcctcaaatttcttaaccttctcatcaagaagcttctcaactgcctcacgtgtctcattgacccactggcctacctttggtctctcatcaggagcaacatccttcatgccctttaagactgctgtgagctcacccttctttccaagaattgcagcacgcacatcatttaatttttcaagaccgtcagccttatcaatttcagcaagtgctttttctctgatctgttgaattttgtctctcatcgaatttcacctcataatatttttcttaatttgcataaactcgtaaatccaagcttgaattcgccgtttatgcgataaaaaatgcccctgcatggctattaaaccatgcagggacgaaaattccgcgataccaccctgatttccattgaagaaatatccaatggactctcattgatatgtgtaacgtacataacacgtcatgaactactgtgcttcatccatgcagcttcagtgtgaacttcaatcaatagcctttttgtaagactgctttcagccgatgacaatctctctctggtcaaagtactataatctactatgcaccttcattgcttttattatatatagctgcgacatatatatcgcaaatgcttatttcttaataacacataagtcattttagcacaatctctatattttgcaagtagaaaatttttctattttctttatattttatttctaagccccttaggataatggtttttaacctgtgcaccattcaccttgccccagccggccggatatccatctacacatacaagtgcccagccctttttgcattcagccgcctgctcatcagataacataactgactgaccattgaaaaagccgatagtctgcggattgtcacatgtaagctttactacgtttttagcatcatttagcttaagtgcaagtgccagcgaatgcgacggctcaaagcgctgttttttaaactctcctatatgaagccctgctcgctgcaccttaagccctttaatatcaacttccatatcaggcagcctgtagagctgctccccaaacatgacaagccttgagttttttatccatgctgccatatcctctgatatggtctcatcaagaaactctgagagaagcttcatattttcttttgtgagagccggctttgtttcatttttcctgttcttactatttttgttctttttggttttcctgtcagctttaaggtctgtgtccacacagcctcttctcacaagctttgccacaaaatgtccctctccgtccaccttatgcggccagaagcgctccatttcttcaagtgtaaaatcaggatgtctctccaaaaaatactcaattacatcctcattttcttccttcgagaaggtgcaggtgctgtacactatcgtacctcccggcttaagcatcacagcagcattatccagtatttccttctgccttgccgcacagattgccacattttccatgctccactgctctattgcctcaggcagctttcgaaacattccctctcctgagcaaggtgcatccacctgtatagcattaaaaaagcctgggaaatgtgaagcaagcacaaagctgtcctcatttgtcacaatcgcatttttgattcccatacgctctatattctgcgacaaaatccggcttctttgtgtattaatctcatttgataccaaaagtccgctgtctcctaaatatgtggcaagctgtgtgctctttccgccgggtgccgcacacaggtcaagcactctcatccccggctttggagctaaaagtgcagccgccgacatggcacttggctcctgtatgtagtaaagccccatctcatgatacggatgctttcccggacgcacattttcatcaaagtaatatgcctcatctgcccacgaaacctttttatctgaggatattttaagtgttttcaatatcctcattctttcttccgggctttgcacctttaaggtattgaatctgagcgcctgaaatctgttattgtcatagctgtataagaaatcatcccactcatcacccagaaaggccttcatctttttttcaaactctatcggtaaattcattgtcaaatcctcttgttttcttacgaaataattacaatgtatcttactatcacacacatagtcatgtatctaagcacttcgatattaccacatttctactatccatgctatcaattttttgtaggcatatcactgctcactacgtacactgcttatatccaccactgtcacatccttataataatatccgattatatccttatagctgcttcctgcctttgccagcttgtctgccccatactggctgaagcctattccatggccgaagcctccgccggacagtgtatagtgaccatttgcaccggcactcacactaaagcaggcgcttggtatcatcgacatattctccctcacagagccatcgtttaatgtaacttttttctgataatgccctaacgcctttcttatatcattctccgccgtaaaggtctgcgatttgtttccataatttattgtgagcgaaagtacatacccagcatccgacgtcttatcgacagaaatacctgttgctgtgccatactgaggatcattgtatgccgataaatcaagctccgaggtccatctgtagtatggcgaattgtcatccaccgactccaccttgtgtatgaaatccggtgtactcgaagaccatacctccatatcctctgtttttccggcagatgtagaaaaataataacatgttattaagcttcctccacatgagacaacctgtcctgccgtagcttttacagcctcatcggtcgattgctttgtttctgaagcgttatagacctgaaaagccgtggtattgtcaatatttgctccgtatagcgcatactgtgtatttttcatctgtgaatatacaaaggttcttgcgcaaacagcctgagccttaagcgcctctgcatcaaatgtagacggcatctccgacggcagcacatagcgcacatatgtctccacatcgactgtattcaccgccacaataccttcctctgtcccgataaactcaaatgagcccggatagcttttaccgtttatgctgacataattgtctgctgagctcacctttatccggcttttttgtgcatttgccatatatgcacccacatcgtcaatagcattgcttccacagtcagcatcatccacataaaggttagctgcggcagctgccgcaattgttggaaatgcatcctttccatcgttttttataagcactcttatgtatgtaaggtctggtgcctgtcttctgacgatggcacatatcctgccggaatcaagtatgtaagaaagtgtttcacttccgattatcaggtcagaaaccgctatttccttaggcgctgctcctgtctcatcatacaccggcagcttgtctgactgcattggaatgtcaccctgccctgcaatctgcatggttccgtttccgtatgacagcatcacacctgatatatcatccggctttatctgtatctttttgaccttagagccactgatttcaatatcacagacccctgtaaagctctcctccatggttcccttagccctgtaaagctctccatcacatatgaaaatcagccttccatcgtcatttgacacaatatatgcattctcatacaccatatccttcgtcacagccctcgcctgttttacaagtgcccccttttccttttgcgccataacaattgcaaaaacaataaccacgcataccacggttatcgcaagcattatccagaccatctgattcggcttttgccgtcttcgtcttctatttgccaaatttctgttctccttaacacccaaatagtggttactgctcaaaaaatgggagctgcaaaaacagctccctttatcatctgtacttaagaatcctttgtgctttaaaaatcttttgtatctcataaatcttttgtgcgtccggagttcttttgtacattattattcttttgtaagaacccaaaatgccggtcctgtaatttagactcctagcgctcttgctaggtgggtaaccgcagtctgccttctgccttccgctgcataatgacggcctgacatccaacagctcatataggaatcccgtttaaagtaaatgtaggttctaaatacacagggttgtcgaacatctcaggtatctttgtaaattcattatactttattatgtctcatgttgcaatgcaaaattcatgttagaatttaacaaatttttctctggcatttcgtaacatatttgaaaaccagataattactgcgacgaatataatcatctccacatatgaccagtacggtatctttttgaggcaatccgaaactatcgcaactatactgataacaaagatcacaatgccgaatacaagtgactttggataaatataagctatatatccggccgtatcctttatctttttcatctcatcctcagccacaaaggtactttcaattttgccgcttttcttcattcgcagtgacacaaatattatgtaaattcccagtatcagtgtgaccgcatctattataataaaatagttcatgcttctttctcctgtatttttatttattattcctaaatagttatcacggatcttatatatacaaaaaatatgtaaaatcaccaaaattagtataacctcatgtaaggaaaaaataaatggtaaataagtcccaactatttcttgaatttttattattaatgtagtagaatatatttatattttcaaggggaaggagtttttaaaatgcagcttgacgatttaaaaatacttatatgcgatgattcgattctcgcaagaaaacagatgaaggacataatcaattccattggttcaccgactatcattgaggcggcaaacggacagctcgccattgatatgtacaaggagcataagccaaatctcacatttatagacattgtaatgccagtaaaggacggaaatgccgctatctcagaaattatggagtatgacagcagtgctaccatcttcgtagcgtcatctgtcggcacacaatccgagcttaaaaaggctcttgctgccggagcatgtgacttcattcagaaaccaatcgacaaggatcaggtcataagtctgattaagaagcacataggaggaaattaatatgtatactcaattttttggcaattttctcctatcaaagggatatatcactaatgagcagctttttgacgctctcaaagaaaaagcacaaaagcacgcaaagctcggtactctcgccatccactcagggcttatgacagctgccgaggttgattcagtaatagtcgagcagacccatcaggacaagaagtttggtgagcttacaatagaaatgggctatctgacagacgagcaggtaaaggagctcttaaacatccaaagccctgactttcttcttttaggacagattcttttagacaaaggcataattgacaataccactctcgaaaagagtatacatgattaccgcaatgagaatgctatttccgatcttgacatggtactcgaggataaggacagtataaatcatctgataggtcatttttttgccaatacaggcatagatccttctgccattgacattatgtatcttgagcttttgtttaacagctttatccgatttgtcggtgatgactacactccgctctctgccgagatatgtgacagctttagtgcggactgcatggtacgtcaggacatcgagggcagctatgccatatctacatacataggcatgagtcagacaacagccatcaattttgcatcacgctatgtaaatgaatcattttcagtatacgacgagtatgtacaggcatctctcgatgatttcctgaacctgaacaatggactgtttctggtcaactgttcaaatgatcaggcacttgagcttactctcactgcacctgagcattttgatggacagacacgcagcttcaataaagcctgcaagctcaagctgttataccctttcggagccattcactttattattgaattctaatatctctgcaaggcggtttcagtaatctgataattatttactctataattagagcacaaaaagaacatctgcaatcagcagatgttcttttatgttgcgctatacataattatatatcaaacaaattacaattatatgattaaatgggcaaaaggtaacattatattattactgcacaccgagcattttcttaacagtgttttccatctgatccacatcacagactgtgttgtgaagaatctttgcatccctgatttcctcgatggcatttggtaccttaacgttgccaagctttgaaagctcatcgacaagctcaaagtctgtcattgaatcgtacttaggatcaattgcatccatcacacttcttgtgaatttgaatggacttgctgtagatgcgataacagtctttgtggctgtatcacctgtagcatccttatacttgctatatacacctgctgcaactgctgtatgagtatcaataatgtatcctgtatcctcgtaaagctttttgataacctcagcggtttccttctcacttgtgtaatttccatagaagtcagaaagcttttccttcatctcaggtgttacagtgtatttgccatccttagcaagcgaagccataagctgagcattcttatttgcatcatttcctgcgatacggtaaatgagtctctcaaggtttgaagagatgagaatatccatggatggtgaatttgtgaggataaactctctgtttttatcatactctcctgttgtgaagaaatcgtaaagcaccttgttctcgtttgaagcacagataagctttgcaacaggaagtcccatattctttgcataaaacgctgcaagtatatttccaaagtttcccgtaggaacaacgatatttatcttctcatcctttgcgacagctccctgtgcaaaaagctttgagtaagcatatacatagtacacaatctgtggtacaaggcgacctatattgattgagttagcggatgagaactgatagcctgcggcatccatcgtctctgcaagagccttatcattgaacatagcctttactgctgactgtgcctggtcaaagttgccgtgaatacccactacatgagtattagcacccttttgtgtaagcatctgcttctcctgaatcgggctgacaccattctttggatagaaaacgataatctgtgtcccctcaacatcagcaaagcctgccatagctgcctttcctgtgtctcctgatgtggctgttaaaatgacaatttcgtttttaacattgtttttctttgcagatgtgataagtaaatgaggcagaatggataatgccatatccttgaaggctattgtagagccatggaacagctcaaggtagtaagccccgtcagcaaacttaagcggtgcaatctcagtagtatcaaacttgctgtcgtatgccctgttgatacaatttttaagctcttcctctgtgaaatccgtaaggaaaagcttcataacctcatatgctacctgctggtatgacatcttagaaagctcctcaacagaaacatcaagtgccggaatgctctcaggtacaaataatcctccgtcatcggcaaggcccttaaggatagcctgtgaagctgttattttcttttcactgtttcttgtgcttgaatataataaatccattttttacctcatttctctttttatctctaaatccatattgctacatctctatatgcagacaattattatcctttatagtataataaatttcatatatcaaatcaataacaaaaatgctacaataatatatatatgattaaaaatatatgtgaaaggaacacaaattatatctatgctccagggagtttacaccgctgtcagaaaagacggcaccatttactacaggtccaacatcacctacaaaagcaaacacatcagtctcggaagctttgacagtgagctttctgcaagccgcgcctatgccactgcatcgacaattttattaaaagaaacaaacagcatagaggactcttactttcacacccatgcacttgcatttgataaaattgtaactcttattaatttccgtgataacggcatgtacataaagacgcccatatatctgcgcaaaaattatttcagctactatctggatatatcacatgagctgaaattcgatatagacgatttgttttactactctgagcatcgcatattaaaacgccagggacatctgtacgtcaacgactacggcatgcaggtcaccctgcttagccgctatggcatacagcctcatgctgtttgcggacgggactatgtatttgtaaacaacgattcaaccgacatgcgctacgaaaacatcaagctgttaaatccataccatggtgtagagattgtcaaaactgcagggctcgacaaatataaagctcgcatacacataaacggtaattttgtcataggaacctacaacacaatcgaaaaggccgctattgcctacaataaagctgtcgatatggctcatgcacatggcatagaaaaaaactatcccgaaaactatatcgaaagtatatcaggcaaggaatacgcggatatttacacttctgtgacagtttccgataaatatgtgcagtatctgcagcaatttgatttatagaacacatatcccatagttcgcatattaccattacttttaatattgtactaaaaactcccgcggttatataacctcgggaatttttataattacttctgatttatatagtttacaagtccctcgcagtcgataatcttctgcatgaacggtgggaaggcctgtcccttaaacttctctcctgttgtctcatctgtgatgataccggaatcaaagtccactgtcacctcatcacctgcatttattgcctttgctgcctcagggcactcaataataggaagacctatattgattgcatttctgtagaaaattcttgcaaatgtctctgcgataacacagcttacgccggcagccttgatggcaatcggtgcatgctctcttgatgaaccacagccgaagttcttgttggctaccatgatatctccggcctttacattatttacaaaatccttgtcgatatcctccatgcagtgtgttgcaagctccttaggatcagaagaattcagatatcttgcaggaatgattacatctgtatcgacattgtctccatatttaaatacacgaccgtgtgctgctttcattgtgcttcctccaatctttacataacatcctttggtcctgaaatcttacctgtaatggcacttgccgctgcaacagcagggcttgccagataaacctcagaatccacatgacccatacgtccgacaaagttacggtttgtggtagatacgcatctctcgccctcagcgagcactcccatgtatccgccaagacatggtccgcaggtaggtgtgctcacaatggcacctgcctcgataaatgtcttaagaaggccctcttccatagcctgaagataaatcttttgtgtggcaggaatcacgataaccctgataccatccgcaacctttttaccctcaagaatctttgctgcaatacgcagatcatccatacggccgttggtacatgaaccgattactacctggtcaatctttacatcacccacctcatcgatggtacgtgtattgtcaggcagatgtgggaatgaaactgtagacttaagtgtgctaaggtcgattgtatactcctcatcatactctgcatcactatcagcctcatactctgtgaacggacgctttgaatgctccttcatgtactctcttgtgagatcatctacagggaagataccattcttgccgccggcctcaattgccatatttgcgatagtaaatctgtcgtccatagaaagatatttaagtccctctccgacaaactccattgacttataaagtgcaccgtccacaccaatcataccgatgatatgaagtatgacgtccttgccgctgatccactcagccggttttccgacgatattgaacttgatagcagaaggtaccttaaaccaggccttgcctgtagccattcctgctgccatatcagtacttcccacacctgtagagaatgctcctaaagctccgtatgtacatgtatgtgaatcggctcctataatcacatcacctgctacagtcagtccctgctcaggtaaaagtgcatgctcaatgcccatttttcctacatcaaagtaatttgtaatctcatttttgcaggcaaactcgcgaacacatttacagtgttctgctgacttgatgtccttgtttggtgcaaagtgatccataacaagtgcgattttatctttattaaacactccctctaccttcatcttgtcgatctcatgaatcgctacaggtgaggtaatgtcgtttccaagcacaagatctaaatcagcctcaatgagctgtcctgcactaacagagtcaaggcctgcgtgtgcagcaagaatcttctgcgtcattgtcattcccatgcttatatcctcctagcatataaaaatattgtattatgattgtatctgaatcaagtttacttaagacatcataacatatgatttaccataataaaaatacataataaacatatttaccataactaaatctcatggtataataaacataaatttgttgatgttcacacctttttgtgacaagcaacgattacagcccattaaaagtacaaaccacaggaggtacaaatgaaccagaatctctcatcttactggattttctatactgtcgccaatgccggcaatatatcaaaggcagccaaggagctctatatcagccagcctgccatcagcaagtcaattcaaaagctcgaggacggactggaatgcaagcttttttccagaagctccagaggtgtcgtcttgaccgatgagggcaggcttctttatgatcatgtaagcgaggcctttgaggcattaaatgagggtgaggaaaagctgaagcgctcaatagagctcggtgtcggccagcttaagattggtgtcagctcaacactctgcaaatatatgcttttgccatatctcaaggaattcatacacagaaatcctcatataagcatctcaatcgaatgtcagtccaccaacgagaccttaaagctcctcgatgatgacaaaatagatataggtctgattggaaaaccagcatcccttaagactttcaatttctattatctggacaacatcgaggatatatttgtcactacaaaggactatctgcgcaacttaagcgcccgtggtgtcaaaaagagcgagattttgcaaaactctactctcatgcttctcgataaaggcaatatgacacgtaaatatattgatgattatctgcaggagaaccagatacacgtaaaggactctatagatatatcaaatatggacctgctcatcgactttgccaaaataggcgtaggtgtggcctgcgtcataaaaagcatagtttcaaaagagcttgctgatggtaccctgattgaaattcctctcggcataccaatccacaagcgtgaggttggctttgcctacaaggagtcttcaaagctttccacctctctgcagacctttatcaagttttatgagagctacacaccagaggatttttaaataaaaaaatatgatcccggaggtattaccttgaaagaacaaatacacactatccccatatcagacgcctttgacaatgccggcgaatgccccttctgctatatagaaaaacgcaccgaggatcacgtcatggattttgtacttggtcatggtgcctcttacatggaggctgacgtacgcgatatgaccgataaggagggcttctgccgtgcacatttcaaaaaaatgtttgactatggcaattcactcggaaacgcctggatactaaaaaccatgtacatgcgccatattgaggagatggacaaagaatttaagaactttaagcctgattcagtgcaaaggagcggtcttttcaaaaaagcaaacgcctcctccaattccatcgtggactggattaacaaacgtgaatcaacctgctttatatgtgacagcgtaaacaagacctttaatgcatacatgaagaccttcttcactatgtatgaaaaggatcctgaactaaaagaaaaattaaagaacacaaaaggattttgtctcgatcacctgaaagtggttcttgaaggagctgacacttatttaaaaggtgataagcgcaaagaattttacgatatcgtgctccctctaatgcacgaaaacatgaaccgcatatatgaagatgttgcatggttcatcgaaaaatatgattataaaaataaagatgccgactggaaaaattccaaggatgcgatccagcgcggtatgcagaagcttcgcggaagtgatccatctcttccaccacatgttctcaaaaaataaaatcacccggtattctgccggccgtctagtggctgtgcaaaataccgggtaatttttatttcattacgatgtttacaatacgtcccggaacataaatctcttttacgatatttcctgtaagcttatctgcaataacatcctttgcttttgcgataacctcatccttaggatcctgttttccgattgcaagagtgcccttagtctttccgttgatctgtacagcaatctctactgtatcctcaacagtctttgcctcatcgtataccggccatggctcaaatgcaattgtatcgtcatgtcccattctctgccagatttcctcaccaacatgtggacatacacaagaaagcatcttgataagtccctctgcaaactctctaggacatctgcctgccttgtatacttcattgacaaaaatcatcatctggctgatagctgtattgtagccaagtgcctcgaagtcgtttgtgaccttctttactgtctgatggtagattcttgtgagctttccgtcatcctcttcgataatattctcaggctctgtaaagaaattccatacacgtgtgatgaatctctttgctccctgtacgttgctgtcgttccaaggctttgaaacctcaagtggtcccatgaacatctcgtagagacgaagtgtatcagcgccgtactcctcgactacatcactaggatttactacgaactccgggaatctcttgcccatcttgataccgtttgatccaaggatcattccctgatgtacgagcttcttaaaaggctcctttacaggagataagccctgatcaaagaggaatctgttccagattcttgaatacatgaggtgtcctaccgcatgctccggtccaccaacatagagatctaccggcatccagtgctttaagagctcctgatttgcaaattccttatcattatgtggatcaatatatctcatataataccatgaggatcctgccgagccaggcatggtggatgtctcacgagtaccctttacgccgtttctgtcatactgcttccactctgtagcgttctcaagaggtgccttgccattcttgcccttgtaatcctcaagctcaggaaggacaagcggaagctcatcatcaggaaggaaatagattgaaccatcctccttgtatacgcatggaacaggctctccccagtatctctgacgtgcaaaaatccactcacggaacttgtagtttacagttctctttgccacgcccatcttctcaagcttggctgtgatagcttccttagcatcctcaactaccattccggtaaactcctctgagttgatgagcttgcagccctttccaagataatcatgcttctcaaatgcatgctctgatacatctgcaccatcaattacctgaatcatctcaatatcatgagcctgtgcatactcgaaatctcgctgatcatgagtaggaactgccataacagcacctgtaccgtagcttgccagtacgaaatcaccgatgaacattcgcacttccttgccgtttacagggttgatacaatgaagtcccttaagctcacagcctgactttgtcttgttaagctcagttctgtccatatcgctcttctttacagtctcatctatgtaagcctgaacctcttctttgttctcgactctgtccatgagaccctttactatatctccgtccggagcaagcaccataaatgtgataccatatattgtctcgatacatgtagtaaagatagagaactctccaccgcctacaatctggaatttgacctcgacacctgtgctcttgccaatccagtttctctgcatttccttggtagactcaggccagtctatctcattaagcccctcaaggagcttttctgcaaatgccggctggtcaataacccactgtttcatgttcttgcggactacaggatagccaccacgctctgacttgccatctataacctcatcgtttgagagaactgttccaagctcctcgcaccagtttacaggcatatcaatatgctttgcatatccggcctcataaagcttcttgaaaatccactgtgtccacttgtaaaactcagggtcacttgtagaaatcatctttgaccagtcataatcaaaaccaagctctcttaactgctttgagaaggtctctatattcttctgagtgaaaccgtttggatgatgacctgtgtttacagcatactgctctgccggtaaaccgaatgaatcatatcccatcggatgaagtacattgtagccctgcattctcttcatacgcgacatgatatctgtagctgtatagccctccggatgtccagcgtgaaggcctactcctgaagggtaagggaacatatcaagtgcatagtatttaggctttgaaaaatcccaaacatctgtcttgaatgtctcgtgttctttccagtattcctgccattttttctctatggccttgtgattgtatggttctgacatacttgcctccttatatcaaaaacgctccgcctctcaaagagacgaaggcgtatttttaatccgtctgattaacattcataattttacacatcacactatattttgtcaagttttgctatataaaaaacccggtgcattactgccccgggtcttattgtcatatatatctgacagattagttgttgatgagcttgtcgctctcatcattccagctgtaaagcttacggatttcctcaccaaccttctctgaaggatgctcagaagcaagctttctcatagccttgaagtgtacctgacgtcctgctggtgacatatcaagtaagaactccttagcaaatgtaccatcctggatgtcagaaagaatcttcttcatagctttctttgtctcagctgtaacaatcttaggtcctgttacataatcaccatactcagctgtattagagatagagtatctcatacctgcaaagcctgactggtagataaggtctacgatgagcttcatctcatggatacactcgaagtatgcgtttcttgggtcataaccagcctcgcaaagtgtttcgaaaccagcctgcataagtgcacaaacaccaccacaaagaactgcctgctcaccgaagaggtctgtctctgtctctgtacggaatgttgtctcaagaagtccagctcttgctccgccgattccaagaccatatgcaagtgcaaggtcccatgcctttcctgtagcatcctgctctacagcgataagacaaggtgttccttttcctgcctggtactctgaacgtactgtatgtcccggagccttaggtgcgatcatagctacatctacatcctttggtggcttaatgcatccaaagtggatgttgaagccgtgagcgaacataagcatgttgcccggctcaaggtttggctcgatgtccttcttgtacatatctgcctgtaactcatcatttataagaatcatgatgatatcagcctgctttgcagcctctgcagcgacatataccttgaagccctgctcttctgctctcttccatgacttgctgccctcataaagaccgatgatgacattgcatcctgaatcctttaagttaagtgcatgtgcatgtccctggctgccgtaaccgataatggcaattgtcttgccctctaataatgaaaggttacaatcatcctgataaaataatcttggttctgccattttgttttcctcctgttaatttaagtaaactatttatatgtaaggattgtcctgtgactaatccaacataactacatcatcggaacctctggtaagtcctgtgattcccgttcttgcgagctctaatatttcatagccgctaagtaagtctatgaacttatcaagcttgtcctgtgtacctatgagctcaataatcatagagtcatgagtgacatcaactatcttgccgtggaaaatctcagtcacattcataactgcctgtctttgtgtatcgagtgctcttatctttatcataataagctccctgcacactgagagtcccggctcaagcttcttgatatcaagtacatcctcaagcttcgccaactgcttctctatctgctcaagcacctgctcatcaccgcttgcaacaattgtaatacgtgtgtagcgcggatctgctgtaacccctgaagagaaactatcaatattaaatcccctgcgactgaacagtcctgaaatacgactggtcactccgggattgttctcaactaaaagagataatgcctgtcttctcatcgaaaaaccttcctcacaatttctattatttctgttcacatgatgataatattactataatctgtatttgtcaagcaatatcgttaatataacttaaattcatattatcaataacaatatttatacatccataacctcgataaatgcctgttttataacgttttatacagtatcttcaaaaaaagccgggcgacatacaaccgcccggctttagaattatctaatataattctgtttaatatattataactgtggtcctgctgcaacaagtgctttaccagcctcatttgttgtgtacttaacaaagttcttgttgaatctctctgcaagatctttagcctttgcctcccactcagaagcatcagcatatgtgtcacgaggatcaaggattcctgaatcaactccaggaagctctgtaggaacctcgaaatcgaacatagggatcttctttgttggagcattaaggatatcaccagaaaggatagcgtcgatgattcctcttgtatccttgattgtgattctctttcctgttccgttccatcctgtatttacaaggtatgccttagcgcctgacttctccatcttcttaacgagctctgcagcatattttgtaggatgaagctcaaggaatgcctgtccgaagcaagctgagaatgtaggtgttggctcagtaattccacgctctgttcctgcaagctttgcagtaaatcctgaaaggaagtagtactgtgtctgctcaggtgtaagaatagatactggtggaagtactccgaatgcatctgctgaaaggaagattacgttctttgcagccggtgctgaagatactggcttaacaatatttgtgatgtggttgattgggtaagatacacgtgtattctctgttacactcttgtcctcgaaatcaatctttccatcatcagcaactgtaacgttctcaagaagagcatctcttctgattgcgttgtagatatcaggctcagactctttgtcaagaccgataaccttagcgtagcatccaccctcgaagttgaatacgccgttgtcatcccagccgtgctcgtcatctccgataagaagacgcttaggatctgtagaaagtgttgtcttacctgttcctgaaagaccgaagaagattgctgtgttctctccgttcatgtcagcgtttgctgaacagtgcattgaagcgatgcccttgagtggaaggaagtagttcatcatagagaacatacctttcttcatctctccgccgtaccatgtattgatgataacctgctcttttgatgtgatgttgaatgcaacacatgtctctgagttaagacctaactccttgtagttctcaaccttagcctttgaagcattgtatactacgaaatcaggctcgaagttctcaagctcctctgctgatggctggatgaacatgtttgttacgaaatgagcctgccaagcaacctcaacgatgaaacgaactgccatacgtgtatccttgtttgctccacagaatgcatctactacgaaaagcttcttgttgcagagctctttcttagcaagatccttaactgttgcccaaacatcctctttcattggatggttgtcgtttggatactcaggtgtattccaccatactgtgtccttagaattctcgtccataacgatatatttatctttaggagaacgtccagtgtagatacctgtcataacgttaactgcaccaagctctgtctccttaccaacctcgtaaccctcaaggccggcttttgtctcttcctcgaataatgtctcgtaagaaggattgtgaacgatctctgttgttccggtaatgccatactttgttaaatcaacatttgccatttgaataaacctcttttctataaattatggatttacatccatttcttttgttagtatatatgtttgttaaaaaaaaatcaatatctacttttcaatttacacttatttcacactttttcgacatgtataatatatttcccacacatcagccgttcgcatatctggtgagaaactgcctggtacgctcctccttcggatggtcaatcacctcatgtgggtcgccatgctcaacaatcacaccaccgtccatgaagatcacctgatctgcaacatcacgcgcaaaggccatctcatgcgtgacaataatcattgtggtattctgctgcgcaagggaacggatgaccttaagcacctctccggtaagctccgggtcaagagccgatgtaggctcatcaaagcagagtatatcaggcttaagtgccagtgcccttgctatagctacacgctgctgctgtccacctgagagctgatgcggataatggttcatcctctcagcaagccccattctgtccagaagctcctttccatgctcatcaatacgtgtaaggattgcttttttatcctttttaaactcaggtgtctcctgtgccagaaggcgctctgccagagtgacattctcaagtgctgtgtactgtggaaaaagattaaactgctgaaacaccataccaaaatgcagcctctttttgcgaagctccgcgtctttatccttgcccgcttcggaagcatcaaaaagagtctcaccatttacaataatctggccactgtcaggcctctcaaggaaattaaggcaccgtaacagagtcgtctttcctgagcctgatgaaccgattatggcaagagcattgccctcctccatggaaaagctgacatccttaagcacattagtccttccaaagtgtttttctatatttctaacctctaaaattgccatgtcttcctcctacctgaaataatccagctttttctcgatataattaaataaaagtgtaaggattccgacaaatacgagataaaatacacctgtataaaacagcggccatgtaagtccgtcagacttcataaacgccgctcccgcaaaggtaagctcgtatgccgcaataattctggcaagagaagtatcctttaccagagtgattatctcatttgacataggcggaacaacacgcttaatcatctgaagcagagtgattttaaagaaaatctgctgctttgtcatgcctaacacctgtcctgcctctctctgaccggccggaacaccctctatgccacctctgaatataacagagaaataacatgcatagttgatgacaaacgctacaaccgtcgctgtaatacgtccggtctcatcaccactccatatagcctgatgaagccacaagcccggtccgtagaatataatgataagctgaagcataagcggtgtgccgcggataacccatacaaacacattcatgacagcctttacaggcttaaacctgctcaaaagcccaaatgcaaatataagccccagtggcagtgcaaatataagtgtgagtataaatatttcaaaggtggtccaaagaccactcataagtgcttgtgtaacagtcccgaacattttatttctcccgctcaacaactacctgtgcattgttacagtatgcatttgtgcattccatagactttgtaacctcatctgtgagtgtcatgccattccagacaacgtcaatcttctttgaatcaagctccataaccttgttgtcccagtcgataactacaaattcaacatccacgccgagcttctcaccgacaagtctagccatatctgcatcaaagccaatccatttgtcatccttatccttgtaatccataggctcaaactctgtgataccgacaatcatcttgccctgtgacttgatataatccacatcactgtcgctttcagactgcttgaactcgtaaggctcctgctcaaggagtgaatcctgtactccgtatttctttgcaatctcctgcgcgctgccatcagcatatgcttctgcgaatacactgttgatatatgaagcaagatcagaacccttacggcatccgacaccatacttctctgaggtaagctctgttgtatgtactaaatcagggtagcttgtgccctctccaatcatggctcctgccattaaaaggtctatgattgccgcatcagatgtacctgatttaacctccataagcgcatcagcctgtgatgaaaccgaattgtaattaaagcccttttcctttgccacagcctctcctgctgagcctgcctcaactgcgtaggtcatgccgtcgcccttttcgcttttttgtgttcctgcacccttgctgccaccacaggcagtcattgaaagtgctaaagttgctgtcaaaagaagtgctaatcctcttctcatgctcatttcctccatatgttaaataatcattgtaattattcaaaatcatccaataactacaaccttttaacatattagcaaattatcacgctaaagtaaagaggaattatccaccaaatcaacagttatgttcttccattttatacaagccccagacttttaattatataaagccagagtgtcagcgtaaacgcactgagcagtgtcgtgagcattatcgtggtcgatgagataacgccctcatgccccatgttccttgccatgacaaagcagcttactgtagtagctgagccaagcatcacaagaattgcaataagctcactgtccctgaacccgaaggctaccgcaataggaagaaatactgccacaaagcctacaagcttgataaatgtggctgcaaatgcaggcttcgcctttgctgatgcttttttcaaatcaaaggtggcccccatggccataagtcccataggcgttgccatattgccaatgctcgtcacagcctttgccggtattcccgcaaacggcagacctatagctgaccacagaagacctgcaacaattcctaaaataataggattggtcactattcccttaaatgtctttttgagtactgccctgtctatgccgttttgccccggcttaaaaaatgaaagcactataacagccatcacgttgtaaagcggtacgcttcctataatcatgacaggtgccatgcctgcgtttccataaatattctggataaaggcaattccaagcagtgccgcactacttctgtatgaggcctgtataaactcgccccgtatagatttatccctccacagacaggaaacaagtgttgatattgtaatgcttatcaacgtaaccacaaagcagaatactataaatttaatgttccaaacccttgaaaaatcaactgacgcaagatcactaaacagtaaaaaaggtaaaggtatcttaaacacaaacttattcatcctgtttgcaaagtcttcgtccaaaatccccaccttgcgaagaaaaagtccaaacaccatcatcagaaaaataggtcctgtggcatttagacaaaacattaaattttccatctcaaattaagcctccgtcatatcagtaatctgtagtttataattatactattttgtacattccagctaccacaataagctttgaacttagatatgtcaaccttttattgcactgtagattattttaaaaaattatggtacacttatcgcatattttatttaggaaggaactaaacggtttgaaaattcttattttatcctgtgacaccggcgagggacacaacagtgccggtaaagctataaaagaagcggcagagcataaaggacattctgtgacaatgatagatatgtttctcttatcgggtaaaggaacatcgcacgcagtatcaggagcatatataggcattgtaaagcatattccgtttttcttcggactactctataaggttggcatgctgatatcgagtgataaacgtaaatcccctgtctattttgccaatgccctgctttgtaaaaagctatcagcatacattgaatcaaacggctttgatgctgtcgtcacacctcatctgtaccctgctgagactctgagctgcatgaagcgaaaaaatctgcttcatatccctgccgtcgctgtgggaaccgactacacctgtatcccattctgggaagagacaaatatggattattatgttattccacacgatgatctgacagatgaatttgcaaaacgtggtattcctgaaaacaagctgctgccattaggcatcccggtacgacaggccttctgtacaaggactgctaaagctgatgcaagaacaagattacatctgccatcctatgtgcctatctttcttgtgatgagtggcagcatgggttttggcaagcttgctgtctttgccgcagagcttgcaataagatgccataataatgagcatattgtaatcatttgcggcaacaatactaaaataaaacgcatactgcaaaatgagtttaagttcaacaaacgtgtacacgtaataggctacaccaatcaggtttcacttttcatggatgcctgtgatgtaatctatacaaagcccggcggcctcacatcaactgaggcactggtaaaaaatataccgattgtacacactgctccaatccccggatgtgaggcagcaaatgttgcatttttcaaaaaacgtcatctgtctgtctcatcaaagcgtctgtcaaagcaggttgagcttgggaaaataatgatagaaaataaagaactaaatgcagaaatgatacgtgcacagcgccgtgagcgaaagccatatgctgccatacagattgttggtctgcttgaagaactggctcacactgatacaactgactgactataaaaccatataactataaaactataaggaaattatcatgcaatattttttatttacactcttaggcttcgtactcggaagcactctctttgcttactggataccaaaactattaaaaaacattgatatctgcacacttcccgatgaccacaatccgggtgtgagcaacgcatttatgtatggtggatttttatgcggaatactatcactcatatgtgagcttgcaaagggatttatcccggtgtatctgggtcagaaatatttagatattaactccctgccgttcgtaccggttttagtcgcacctgtctttggacatgcatttccttttctacaaaaagaaaaaggcggtaaagctattaccgcctccttcggagtccttttgggcctgtttccggaattgcatccggctgtctatttggcatttttctttatattcttttcagttgtagtaataataaatccacattcgctcagatctattctgacatttggtttttttgcattcaatgtccttttgactataaaaatagcctcaatccagattggctgcttcataatcgcagggattgtgatatacagacacctgataaagcacaataacggaccggtaaagataagtatactgcatcagcggtaattatggtatctgcttttactcattgattttgcttcttacataactgtttattttcatacatataagaatcagcactatcaaataatatttgtaatgtactctccttataatcctccgatatcgcccatccgcaagcgtaatcaatttgcagttcatttccggtgttgtttaatttatctttttccaggcataagcatttcaggatttcatcaacctccgctttatctgtgtcataaatgactaccataaattcatcgccgccatatcttcccacaaaatctttttcaggaaatacgctgcgcaaaagtccggcaaactttactatcagccggtctcctgccgaatgccccattgtatcattaataaacttcaaattatttaagtcaaaaataatgcatgccgtaggtgaactgattatctcattattgttcagaatttctttacaggcacttctattaggcaatcctgtacgtgcatcagtatatgctctttgctctaacagtttattttgccttgccatcttcattgccattatggtctgtacaataatcaatatcacaagacacagcatatcaagtgctgacaaaagctctatcgtgcggatctttgtagcaatcttttctgaataattttccgctgcagacacagtatcatcagcaagcttaaaataagtctcactcatattgacaatatcagtattttcatatccgctgcttcttacagcttcaatttctttttttattttattccagtaatcaatctggacctgcaatttatcctgatattccttgtcctgaagctttaccagatcataatttccatcctgatattttaatccgcttaaaatatcatccaaatatttaatcaactcatcattttgggatcctgtaatctccaattttacttcacgctgtgttgctccacgtaccagacctgcgtaatttattacccttgccgttccttgcagccggttaatctgtatcatcataaaaataacaagaataaccaatgcaaagatgagacagctttgtataatacctattatatttctgctttttttattctttaacttcattttccgatttatccttgcaattctaatgttccaacatagtctccattattatatacaaatggtccagcctctttctcttctccgaaatactcaggtcttagtgaaagaatacttaatagttcatccatattattcacctttgttgcctgatatggctgctcaaatgctattttttctacaaacaaataatagtcattgtactttatcaatacacctgtatgtcccacgaacatagcatcagaatccggatcatatattgctatactaataagtgaaatacgattactgtctatttgaaatccatactttttccagttgtcagagaatgttttttcaggatgtttatcatccgtaatactcttttctccatacaatgtagtaaacatgtccttattctgccttatgatttcatacctgtctacattatctattgcttccgtatcaaacattaaatatgtgccactatagctatcttccgttgactgtgcgtgaagcagtccatccagcaaaagaaaagctgtcattctgcaatctgcatctgaatagtcatgctttttctcccagccatccatacatttaacagtatctgctttcattttatatgcatctgaccaggtatccttcagctttgcattcttcccggcagaatccgcaaaatcggtcacccattctttaaaggtatctacatgcgatgccccggctgaaccaagctcatcgcacacctcagtaatggtattgcttccacccatatatgttgcagttggcagctcctgttttttattcgaatcctgctgttccgactcctcggcagtatccgtggtaatattatccttgtttatatttttattaccacaaccgcccaacagctctgcacaaagcatcattccaactattattgtgattaatttcttcttcatgattatcatatctctttctgattatttgtactgtcctgtacttttttaaagtacattactatttgtactatgtaaatagtatgctgacaaaattaaagaaatattaatcactaaaacttcacacatgtcaaatgttgatagtgccgtccggtgtgtagacttacatcttccgatggaagaactcgtcaggattatcctcctttaacgcatcttacacatgttttttcgccacttacatccaaatgcgagacattatatatgaaatattgtatgattaactcaccaaaaagaaaggaggattttacatgaaggtaagtatagaactttcccctgaatacagcgaaccatatgccataatatatgcagataaaatcactgacagcatccagcgtacccttgatatattcggttcaaatgaaagccccattacagcttttaaaaacgaaaatgatattgttattttacagccaaaagaaatatacatggtaagggtagaaaacaaggatactattatttatggcaaagaacaccgctaccgttcccgaaaaagactgtacgaaatgcaacagcagcttggtgccggatttatgcaaatttctaaatcaactttggtcaatctgtcttatatgagcaatgtcgaggctggttttagcggcactcttcttttgaaactaaaaaacggatgtaaggattacgtatcaagaaaatatctgcctgagtttaaaaaatatctgggattataggaggacaaaaatgagagaaactatgaaaaatttgactaaaaacactataaccagcattggtatagcattaaccgttttctgcgttacaggaatggtatttgacatcgcctatgacggtaatttcagtttagataattaccaattttccaaaatggttatcggatgcataattgtaggtctgggttttggacttccgacaatgatttatcacaaagacaatcttccaatgccttttaaaataattattcacatgggaacaggctgtgttatttatacaatcgtcgcatatactgtcggatggataggaggaacaagttctgtccttcatggaattattgcagccatatttcaaatagctttggcatttataatttggggaggcttcatgcttcactatcgcaatgatgccagaaaaatgaatgaaaaaatcaaggaattatagacttgttcgtactgcgtgtctgtggagtgatactctgcaatatcgaactaaaaaacgagggcaaatcaaaccgatttacatcgaatttgatttgccctgtaaataccgtttgtattctatatcttttccgttatttgtgtgtataaatatatgatactgatttatttactttacgcaatactttttccattacaaagaggaagccggtacatgtgaagtatccccgcctggtctatgaaaaaatttaatatgagaattttttttgtttaattgtgtggatgggttgaatagttcgaagaaatcgctaaaaatataatagctttaaatattagcggaaatatctccacttatattttgcgaaattttgttatctctttccagttacacggaaatcccatatattcaaaaagatcattcaacttcaaatttaaattctgcttttgatatctgtcaaaaatatgccataattgctttttaaacagtaaaaaatcagtctttggaagtagataacgaaaagtaatgactacactaaacaagtcatttttaccatatatatattttgaaccgtttttagaaattcctaattttttatgtaacaatgtatctggaatgtcaatatatgtgtgatatgaaaacaacctttcgttatgagcacatacatttcggtacagcgttaatacctttaaatattttatcatttcatttttcttgacatttccaaaatcctggcaaattgctccttgcatattttgaggtaagaattcaaacattttggatatctgaccaaaagtaagggtattcataatcacccataacggaatattatgatatttgttacgttgataaacaagatattcatgatccttatttttattagccatcatatctagcattttgattaatttagtaattccatttttattttttgtaatattgctgtaattattgaagttaagatattcttcttgacgttctccatattttttgcagaagtgataagaaatggacgaacgcatttttctttctacacgacataaatatttaaagaatattccacgtaactcttcatcaaattcataaagagcaactatatcttcaaaacatgcttcattaatgtatttgcgggtatgaatatcaataaaaggatgtttgtatccgccaattagtgcatagtaactgatattttgcagggattctaccgcaaagtcatcatctgtaataactagatttttttcatttttcagtttttcaatctgtgcggtatatgtaataaacggtttgctcatatgtacctcgctgcaaaatgttccaaataaaaaaggagaggggcctcggcaccctcccccgatcgcaggcttctcaagtttctgcaatctgatcactaaagataatataactgatataactaagaaagtcaatcataaattatctttatttagattgtattcaatatggttatttttatgtactattcaaatacattgtttaatattcattcatcgctaaatatgtacctgtattactttaatatcttccttatctgcttatccgtcgcctccggatacatctcatgcatatcttaaaatcgcagttgcacagatatgtctgcatcataagattcgttattgcaccatcaaatcctttttctccatccttgccaaatccagcttgttttttcaattcattggaataaatctctgaatcagcattatcctccataaaattgaccattatctttttatgcttattaggagctttcccatcatcatataatgcatcaaaatcatattttgttctgtgttacaataaaactactaaaaaatggctaagtcttttttcattgccttgtagccaattaatactgtccaaacatatgcacaggtttttggaatcatcagcatgccgatcatcggaattacatcagccagcagtacaaccggaatatagaatgcaaagctcaggacgattgtcagccacatccaacgaaaagagctatcgttattttcttttgcacttttatagaataaaactatgataattaatcccatcagtgcaaacggaatatttcggtagattccccatgaaagcggagcatctgcactgagccaggcattctgaggcatcatacacaaaacaattcttaatcctgcaagactataaatagctgctgtagctgctttatagcctttaatctgataacgctcacgccatatatgatagagaacgacataaaaaatagtcatggtgacagaggtaatccacttgcctaacccaagctgtacagtaaagttctcaagaccggttgtacaaagcgctgctgcacgagggaccagatgaaatgcatctccacctcctaaaataactgccataattccaaacatggtaaactgacggtttcctttgctttttcgaatcattaaaattccgattgtgattaccgaaaacaaatatacggtatcaaatatagtttctacaattgcctgcataataaaaatcctttcttaggtacatctttaaacgcataagtgaacaacgttcattttgttgcaaaaattttcccacactctaatgtgggagaaatttaatataatgttttattaatcaacatcaatatcgaagacggattataatcctgacgaatcattgatactaatattaaagaaaataatatatctgcaaactgcttttccgtgaattgttcatcaaatacatctggacgaatcttaggatcattctttaaaatatcacacaatccattaagaatatgcccccatgtctgcagcattttcttctttccatccgttttttcatccttcataaatccaaacgaatgcagtgaaaagaagcccggaaattgctcatttccatattgcagtcttttataaatccatgagatacaggcagcaacatctttaaagacctgctcatcttcagggttaaaaaagatttcacgccaaatactctcaattgtatccccaagcaaatcggccttggattcatagtaattgtagattgtccccgccgaaacagaacatcgggatgcaacagctcgtatgcttacagcagtccatccgttttctttgattagttctctgcttgcagctaatatgtcttcttttgaagttgcaagatggttcacgagttcactcctctccaatgtaatgtcattaagttatttcattaaatgaacggtgttcatgtttaaaatatacactgttcatgtttaaaatatacactgttcattttattttgtcaataacttttttaggaagccctgatacatttatttgacttcaataaaaatggtgtatgccatactcactaagtataacatacaccattaatatttaattattttctatatttatcatcacctgacaaccatcatccgtccatactttaagaacagccggctctttcgatttgacatccttccatcgaactactgccagagcgcttccatcaaatgttgttactgaatcagaaaaatagtcctcctcactagaaggattagctgtaccaaatccttccagcacaccatttcctacaacactagcatgaagcagtcttttttcagcttcctgtgaattaattgtgccattatcatctacaagccatatcttgatatatgctatattcctctcattctcagttacacgacacacttttagctttgttactgattttgctgtagaaagctcatattcacccagtttcctatctttctgatatgcaactgcctttaaagttcccggttcatatggcacttcataagatgctgtaaaatgattttctcttcctaccggttttcttccaagcaatttatcattcagaaaaagctctacttcatcacctgatgaataaacatccacatttgccgttgtcccttcaaagcccttccatgtccagctgctgatgttatccttaaacatccatgcagttttacctgctgtctgtcctgcgtgttcaagtctctcgaccgcaatatatggtttatctgtcagaccatacactatttccctgaaatagctgattggtcttcgatttccaatcaaatcaatatctccgatatatcccaatctctcaggatagatgcttgtgaaattggcatttccatcataatgaaatattcccaccccagcttcacctatatagtcgtatcctgtccatgtaaagtctccaatcacgtgtggataagcttcaacaagcttccagagattttctatgtcagccggatatgtttcagtaccgagaactgtttttgcaggatgcagttcatgctccagctcatatcttccacttaaatagttgagtcctgttatatcacagctttgcgaacattcttcaagtgcttctgaaacaagcggatgctttgcaaaaaactctcctttttcgcccgacatcagactcataaaactgtttaatgcattgcttcctccaccgcttccacttccatgtgaatccattccaaatttttctgcaacatccctcataataacgccaagacgcctgcctgcacagtttaatccattcaatgcattcgttgtatatctggtattatcgagctcatgaaatttattgcatagtattctgtttatccaagctccctgcttagttccagcttcctgtatctcatttccaactgaataaataacaactgatggatgattatagtctttttcaaccatatgattaatccactgattatattcatcttcaaaaatatcagagaaatcatatgtatttttttccttgtcccacatatccgtcagctcatccataaccaacattccaatatgatcacacgcatcaagcattgctctgctcattgggtgatgtgcacttcttattgcattaaaacccgcttccttcaatctcttgcaacggtaccattctgcctccttaaatgtctcagcacctatcacgccattatcatgatgtatacaggttcctcgaagcttaactgtctcaccatttatctgcaatccatgtacaggatcaagcgccaatactcggattccaaaattagaaactgcttcatcacatatttcatcatcaaaccttgtcgttatatgacactcatataaagctggctgtgccggactccatttctttggttgttcaatcggtatttgtacacgcactgtctgcatttgctctgaacgaaatactactctttgcgtatccgatgcagttttctgcccatctttttttatttcaatcagacattctgcctctaatccatgtccaataatgtttttcaactgcgcacacacctctataaccgccatgtcatcattcactgacaatgttgtaatacgcagcttatcatgtgaaatatatacatcttttccggtccacagattgacatctctgtaaattcctgagcctgaataccatctgctgttaggctgtttactgttatcgacatctattcttataatattctcatgctcatagcttatccatggctttaagtcaaccgaaaaacccatatatccattacgattcactgccgctagcgatccattaatccagactcttgcaattccataaattccttcaaattccagaaatacatcctgctttttccactcattttgagccataaattttttttcgtatgtatacacacctcctggataaaatccactctgtgctcctgaaggacagtccttatctcttttttcacgaatcattgcatcgtgagggagtgtaacaacaactgcattactgttcccataaaaggcttttaatctgtcagcctgatcagctttttcaaatgtccagtccttattaaaattatgacactgcatacttcattcctctttcaatctgttagtctgcttgttctgctctttccatgtcaattctcttattttccttttccaccttcattagaccaagaagaatagtaattacaacgccaagaattacagggattgtgatatacatactgaaaatcatatttgtagctgctgcggtctgagttgcagcttttccggcatatcctgctgcatgcaatagccagcctacagccgcagtaccaattccaccaccaacttttactccaagtgatgaacagctaaacatcattccatcaatatgtacccctttcgtacgataggtatatccgctgatttcagcaatcagggcatttaatgttcccgacattgttccggcaaatgttcccttaaggaacataaaaagtaacatcatcggtaaattcttctgcatcgcaaaaataattagaaatattcctaagatatcactgattacatatccccagaaattaaccttttgcatgcttccggtcttctttacaagaatcggagtaaaaataagtgcaattattacagggaacatcttcatcattgagaacactccaagtaatgaaccatttccaagtacatgtttcataaaataaatagctgagcctgttgtaagattactcatgaaataataaacaatataaattgcagcaattaaaatatagtatttgttacttataagtaacttcaaagactcaacaaaacctattttgtcatccttcggtttttgtgtatcatcaactgctgcactaccttcttccggtaactccttaacacacaggcagcttattgtgttgacaacaagtccgattacaccacatataacagcaaccatacgccatcctgcagctccaccgccaaaggcatcaactgcacctgttactgcaaatcccattacaatatttgtagcaactgcaaacatgaaacgtattgatccaagctgaaccctttcattcttgtttctggtaataagggctgataatgctgaatatgctattccgtttgctgtataaaagatagcattgagtgctgtataaaatgcgaagaaatacgcatattgtgcagtttcactcattccacccggaattgaaaacagcagcaccagacaaagtgatacgcctatctgtgcatacagcatccatggtcttgcctttccaagctttgacttagtgcgatcgattaaatttccaaatatcacatctgaaattccatcaagaaatttcgataccagcattaaagttccaataattcctgtgttaagccccattgtatcagataaatataaaaggacaaagcttgatacaagtccatagctggtatttgaagctaggtctcctgctccatacgctatcttctgataccatttcaggtatttcctttctgtttcctgcataataaatgcaacctcctttttcctgttaacaataatagtttgtattgtatttttcataaacgcttatgttttgtatactgttactttaataaattattgcttacaattctataacatatgtgataaaatatcagttagtttttatcatattcgtggataaggagaaaaatataccattatgacctcatcatatactgtcaaaaacatcatagaacaggataatataaacagtacaatcaattcatacatcaaaatacttacaccaatacagttcacactcgaaacatgtaacagagctaacgatgacaaatatctgaattttttgatgacttcaccacgtgaaaatacattttacagctttaaaacagaaaaggaaatcaatcattttaatatgaggcctccacatattcatgatttttacgagcttcttattgtattggatggcgaaatccatcagctgattgaaaagactgattttgtgttccacagtggaagctgttgtcttatgaaccacaatatagtacacaaagaaattttttcttccgatgcaactcttttgtttatcggaatgtcaaaagagctagtccaacagctttcagaagatgaaccaaaagtttattttccggatatagaaagacccggccataaccctattcttagatttctttcagataatctcgataatcctgacacaaaggaatatcttgattttatgccatcgctaaacaacaaagactggcaccatactctccacgccataactgacaatatacttcgtgccattatgtatccaaagcttggttctacttatgtcatcaaaggaatgcttttagaattgtttgattatctgtccaatccagaacactttcatttcacgcccgtccatgtagaagcagacaatgattttcttcttttcacacacataagtcacattttagaggacaccaatggacgcattacacgttctgagcttgaacaattattaaattacagtggaaattatttaaactctatagttaagaaatatacaaattcatgcctattcgattacagtcagactttctgtatgaaaagagcggctgctctcctgcttgaaacgaccgcttctatatctgaaattatggatgaactgcattttacgaatacaacacatttttataagtgcttcaaagaacattatcatatgacaccgaagcaatataggatttcgatgaaaataaaacttgtgccatagttgcaaaatgttcctcatcctgtatccttcagccagattttttgtgaatattcaattttttcaaaatccatataagcattctttaaaagcatttattaatacttaatcctaaaataatccaaatacgccttatacttgtcctgcgcggtcaggcaggtatctgtcagatatcctttttcgttgtcccattccttcaatccacgataatagaacattttcaaattatcctcaatgataaacggaacaatattgtattttagacactctttaaacatagtcaatctgcccacacgaccgtttccgtcctggaacggatgaatccgttcaaacttcacatgaaagtccagaatatcctcaaaattcttttcttctttggcattgtattccgccagcaatgccttcattttatcggcaacttcttccggaagggctgtatccatgccaccgacttcattcggaagtttcttataatcaccaacagcaaaccaatcttttctggaatcgctggtgccattcttcaaaatcaagtgaagttctttgatgaatttctccgtcaaagctgcttttgcatgatcaataatcatgtcgatacaacgaaagtgatttgccgtttcaatcacatcatccacattcagcacctctttttctacgccaatagtattggtttcaaagatatatctggtttgatcatgtgtcagacggcttccttccatatggttggagttgtatgtcaaatcaatctgtgtcttatggtatattccaccggaatatttacttgccttttgctctttcagaatatccaacagcgtaatcggttcttcttttcttttgttaatgcgctccggtttctctgcgttttcaggaaggttccatgtcttacctgtaagaaatgcaccgttcacacgccccttagcacagtaatttctaacactgcgctctgacatattccatttttttgctatttcagcaactgaaagatatcgcatctattatcctccgccataaattatattaaataaccttgttaatctattatatagtataccatatcaccggcaaaaacatcagtacattttaatctaaattattatatttttgccgttaaaaaatctattaagaaatctattttaatagcgttgacaaaggtgtgaaatgaaacgctacattgaacactgtgcaaaagtcacctcgaaaatcgttcccccggtcttgcctgatttaatacaaatactgccatcatgtactctaacgatttcatggacaagagcaagtccgagtcctacgccacccagctcccggcttctggatttatccacacggaaaaatggttcgaacactctctccctaagctcctttggtattccgcttcccgtatcttctacagacagataaacatgcttgtttctctgatatgcggttactgtaacctgtccgagcggatgattatatttgatggcattctcaaccagattgtatacaagcctgtaaataaggatatcactgcctatcatagtggcatcctcacattttccaatcagctttatattcttttccacggcaagaggctcaaggtctgccaaaacctcttcaacaatagcatccaatataattttatcatcccttcccaccgactgaagctcactcatgtcaagaagagtctttaccatcctgtttaatttatcattttgctccgtaaccatttttatggtctgcaaagtgtctgcatcattccccgggtgagtggcagaattatataaatcaagctgtacctgcattaacgctaatggagttcgcagctcatgtgctgcatttgcagtaaactgtccctgtatctcaaatgcatccgacagacgctcaagcatcttattataagaaatacccagctggttcagttccttaacattgttttcctctattcttgaatcagacagattctgagcctgtacctcttcgattttatctgaaaactctctgattggtctgagtgcatgcccgcttataaaataagtgacgacacctcccaaaagcgccagcaaaaccgtgattatcagactgtttcttttatagtcggccttattattgtacacctgaaccgaaaattcatccgcaaactcatcccacttatcgtccggtatgctgatatatatttcatctgatttgtttcctttttcatccccctgtgactctaccgcatcctgcagagaatcgatgtaatgcacaccatttttatagacaaacatagtcaggcagccacatataatagcaatacacaatgtagtaatgcacgtaagtctccattgtagcgacattcttttcatctgtcagactcctcccgtattttatagccttcacctaccttgttcaaaatgggatcatatcccagcttcgccttaagcttttttctaagtgaagacatatgtaccctgattgctccgctaaagctgtctgccgtggcatcccacacatgctctatcagctcctcctggctcaccggtctgcctatattgataagtaaatattccaaaataccattctcttttcttgtcagtggaaccggctctccctttgcatatgcctcgcgtttaatcgtatcaaactttatttctccgcatttaagacatatatcattctgtacaaatttccttcttgtcaggcttctgatacgtgcctcaagctcctgcagatggaatggtttttccatgtaatcatttgctcctgcatccagtccctctaccttatcagcaatctgacctcttgcagataatatcaaaaccttagtttcatcattgtattttctaagctccttaagaagctccatgccatccatccccggcagattcaaatccaaaactatcagatcataattctccgacagtatacattcaagagcctctttcccatcataacaggtatccacctcataaccggcagcatacagactctttgcaaccatatcacatatttgtttctcatcctcaacaattaataatctcaaaatgttctcctgcttcttaacaataattttacaacctatattgtataataccaaagtcagctggtcaacaatacaacaaaaaaggagcaacattatgttgaaataccaaaaaacatgtcaaatcattctgcttatccttggtgtatccatggtaagctatggtgcagtcagaggtgaggcagctaccgtgcttggtaaagcaataaaactatgtctggagtgtgtcggaattggataagaaaaagaaattactatcaaaaaagctggcaaaaatacgtggatggatacaggccgcagcaacgctgctgaccaatattcatattccgaatttatttaagggtaaaatatatcagggtaatgcaaaaacagtatgtgtacccggattaaactgctactcctgccctgctgcgacaggagcctgtccaataggggcatttcaggcagtcgtcggatcatcaaaatttaagttttcatactacataaccggattttttattttactcggtgtaactctcggcagatttatatgtggttttttgtgcccatttggatggtttcaggatttacttcacaaaatacccggaaagaaattatccacagccaaattaaagcctcttaggtacctaaaatatgtcattcttattgttttcgttatacttcttccgatgcttataacgaactctataggaatgggagacccgttcttctgcaaatatatctgtcctcagggtgttttagagggtgctataccgttatctattggaaatgctgctatccgttctgcgctgggaaagcttttttctttcaagtgtatgattttaattgcagtgattgtactaagtattttattttacaggcccttctgtaaatggatttgtccacttggagcaatctactcattatttaataaggtcagcctgctcaaaatcaccgttgatagcagcaaatgtgtcggatgcggtcaatgctcaaaggcatgtaagatggatgtggatgtgtgtaagacaccggatcaccccgagtgcatacgctgcggtgcctgcataaaggcctgtccgaaggacgccatctgctaccggtttatgggaaaatcatgtcaaaaaaatgacaacagataactattaaacattttactattattttaaaggagaaattactcatgaaaaacaaattatcatttatttctatttttacactctgcatagcattatcacttacagcatgcggtggaaagcaatcttccaacacagattctaagaacactcagactgaagccggctcagaaacatccggcaaatcagattccaggcttgatgatttatatcagcaggaaaatcagctttttgcagatcacgctgatgtgtggaacaaggcatttggcatgatgaacaaaagtgacgccgatccaaacggaaattatgctgattatcttgccggtaccgtagaatcaaacaaggattcattcacagacgatgagcttaaaacacttaatgaggatattgaaaccatacgaaaaatcgaggaacagatagcagagcttgaaaacaaaaataaatcatcagacgataacaagaaggacagctctaaagcctcatctgtattcagtgatttttccggtgaggattttgatggaaataaggtggatgacagcctgttttccggtaatgcagtaacagtcgtcaatttctggtttaccggctgcaaaccatgtgtcgctgagttatccaagcttaacgaattaaatgatgctatcaaatcaatgggcggagaagttgttggcatcaacactgagaccttcgatggcaataaaacagccatcaaagaggctgcctctgttcttgaaagccagggtgtcaaatatcgtaatctgtcaattgactcttctagcgctgccggtaaatatgcctcagaaatcatggcatttccaacaactatacttgttgacagaaatggcaatattgtaggcgaaccaatgctcggcggaattgataacaaggacaactatgatgcccttatgaagcagattcagtctgtaattgatgcagacagcacaaataaatagaggtctacatataaaaaagctcctgtgcattgcacagagagctttttagtcaaatttgtaatttatttctatactcgcttggtgtcaatctatatttttctttaaaaacacgattaaaggttctaagacttccaaaaccactgtccatcgagatttctgtcagggtatcatctgtagtttcaattctctgacaggcataccccagacgcgcctcattcacatattgattaaaactgctgtgaaatgtctttgaaaacaatctggataatgaaaatttgctcacgccaaggtcatgtgccattccatcaagtgatatactcttattaaaattggcagaaatatatgatacggtacggtatattatatcatcgctgccaattttgctcttttccaccaatttcatcatcggaatacatcttgctagtataatctgcaaataagcttgaacaacccatatatcattctgcccagtatctattatggattccactgctctgtacacttcatccggaataacatcactttttacaacaggatattgtggagcattattcctcagtacattttcaaatctaccaaaaatcatttgtggagcattaataaaaaccgcctcattgacttctgatgaaaacacctgataatgatgtataacatcaggaaatactactcctatatcacctgtttccatgtgatacagctcctgtcctacaccaagctctaatgttcctttcgtaacgcatacaatttccattgcattatgcagatgtggtggctggtgccgtggcttccgctttactgcaataatctcttcatttgtgttttcatacgttaaatgcactcagatcatctctcccatattatacgataattattcaattcctttttctcttctaagcttttcatttgcagcttctacattcatctttgaaagaagaattgtaataagaatctcaaatacaaatggtaaccataaatacattacctgaagcatagtaattgcagatgccggctgagtcgcatttgtacctacataaccactgatttcaagcagccatcctacaatagctgttccaattccaccaccaattttgattccaagtgatgtgcatgaatacatagttccatctactctctttccctgagtcaggtaagtatactcagagcactcggcaattactgcattcatgtctccctgccaaggtccctgtcctaatgctgcaactgcagtaaacagcatcatcagtggaacgcttcccatgtatcctgctacaatcacaagtgctcttgctatcgtagccagaatatatccacgtttattaagcttatacattcctttccactttccgacaagagttggtgtgaaaataagtgctattattagaggaatatttacagcccacgcaaatacaccaaacagatttttattcttaagaacccatgtacaataataaatacctgccccaatcatagcactgtataactgctgcaaaatataagttccacaaatcatcatatagtacttattcttaacaagcagcttaaatgcctgaacaagaccatacttcttttcttcatcgttctctattccggagttaagctcctcttccggaagctccttaaccgacaatcctgaaattgtatttactacaaggcctatcaaagcataaataatagctacaaatctccatgcagcagcacctccaccgcatacatcaacaaatgcaactgttatagactgaattataagactggttgaaaaggcaaaaataaaacggtaagagcccatctgtacacgctctttgctgttctttgttaccagcgaagtaagtgcagaatatgcaatattatttgctgtataaaatacaccattcaataatgtatatgctataaagaaccatgcatactgagcagtcctgccccagcttgtaggaattgcaaaaactgctacaagtgtcaaagcacaacctatatagccataaatcatccaaggtcttgcttttccgagctttgtatgtgttttatcaataagtgacccaaagaaaacatctgtaaaaccatcaaataatttagatgctgcgattaatgttccaacgattcccgatgcaagtcctatagtatctgtaagatataccataacaaaggatgtcaggaatgcatatactacatttcctgcaatatcaccggaaccataaccaattttgttgtaccactttaagtacgtcttttcttccatgaaaaacctccaattaattactttgttttatctttaacagctatactaattttatatatttgtgcaaattttgtctataaacataataggctgtaatatgcacaaaatgatacttttcaaacactacagtttcacagctatttgactcaattccatttgaaacgtaatcaatacacaatatcatgctctaaacattttgtccataaatgcaaatagacaaagcatgcataaaatgctataattcgaatggaggtgtgtaatgtatattaacacgggatatttgaatcattcacataaagattttaaagataaaagccgccctctgattgtaggaagctgcggaacctatcgcctgtcacagcatcctaagatgcctacatacaggcccagaggaagactggattaccagattatatacatatcatccggtcttgttcatttccactttgacaatcctgaaaatgagacaatcattccagcaggacatatagtgttatttcgcccaaaagagcttcaaaaatatgaattttatggtaaggataagactcagatatattggcttcactttaccggaagcgacgtaaaaaacactttaagaaaatacggatttacagacaataaaagagtctttaatgttggaacatctcttgaatatgaacaggttttcaaaaggattattacagagcttcaaagatgtcaggacaattatgaggaaatgctcatgcttttgctacgacaccttttgattatatttaaccgtaaaataacaactgagcatgtaatcagaaatgaattccttgacagccagatggatacagcaattacatatttcaatacaaactacaaccgctctattaacgtggaggaatatgcttcatcaattggtatgagcataagctggtttatcaggagctttcggaaatataccggtaatacaccagtacaatttctcacagcactaaggatgacaaacgcacaggtgctgcttgaaacgacatcctactctataaacgagattgcaggcattgtcggatacaataatccactatacttcagtcgattattccataaacaaaaaggctgttctccttctgaatacagagccagaaatacataataaaaagacaaaagcaatattataatgccaattttttcctatacttatctttttaatgaatgactaacagattgtaaaagaataatccttatcagtctccgcactgatacgataatcctcttccacatctgttccccagctgtcgatacctccaacacctcttactgcgccatatatgcataaaacagttcttcttgccggtggcagttcttcatggtgaagagcgttttcaatctcagatgcggtataaggcagacaagaaaatgcaaatttttcatcattcttttcaatgcgcagtgtctgtgatgagctatctgtcctgctgttatcaagagccgtatgtcttgtaatttcaagccactctgtatccattctcataccacattcctgcggaacaagatattgtgtaagactcagatcaccgatctcatagactccttcttgtgcacctgcttttctgtcaggatatgtttccccggagagtcccttatataaatatttgtcagccaatgttggcataataaatctcattccaaatacaggaaattcagggagcccctgtactccattataatgtacatccacgcgaatctttccggacgcatcaacgctatagctcacaagaacagttgtcgccggagttgttatggtctcgtatgtatattttacaataatttcatcagcataaacatcaccgccatagctgttattatcaggtgcatatggtttttgctccttgccatccatgatcacctgtattcccttacagtcaataaacatatctgccgaaagccagcttccgcttttaatatggaacttgcttcccctgtcattatctgtcaacgctctccagaaagtaggctttgggcagcgatacagccactcatatccatttttaacgatagattccagtccaccctgtgcataagagaaaatataatcaaagccttcaccatgtacaccaagtgtatagtcgccatataccactcttaatttatctgtataagccatagtaatacctcacttcctgcattgccggtttttctttcctgtcagcaaatacaattccatttgctgagaattcatagtctgccggtttatcatcaaaatctccgccatagcgtaaaacatcttttcctgtaacggaatcttttaccataattgcctgatcaataaaatcccatataaatccgccatgatacatatcgtatttgtcaatcagcttcatataagagccaagtccacccattgaatttcccatgtcatgcatgaattcgcataaaatatacggttttttcggactgttattcaagtattcctctacatcctccggttttgcatacattctggtctcaaaatcagaaatagtatcctcatatgccctattataataagcgctttcataatgaactaatcttccatcctgcttttcagcaaaataaacgttcattgcctcaatgtcgtctcctgcataggattcatttcctaatgaccagaaaatgatggatgtatggtttttaaaagtttcgaaattgttttttgcacgctcaagcactgcatctctccactgtggaatagatcccggtacattgcatgatggttcgattgcccctagtttttggaatgagccatggctctccagatttgtttctgccatcacataaatacctgcatcgtcgcacatatagtaccatggtatctggtcaggataatgacaggtacgcacagaattaatattgtttcttaacatacatgatatatctgccttcatatcttctataccaatgcatcttcctgttcttgcattccactcatgacggtttactcccgtgataacaagacgttttccattcaaatagactactttatctataatctctattcttctgaaaccgatatcataaggaattacctcggccagtgaaccatcctctgctttaagctcaacataagcatggtataaatatggattatgattatcccacagcctgacactttccaagtcaacacaaatcgtgccttccaaatggttgttttctttatttaactgtaatgacttctcaactaatatattttcttctctgtcttttaaaataaagccagcagttacattctgactgtcaggagcagataccttcatgctgacagatacgcttccgctttcattatcttgatttaacacaggtttgaaccatacatcctccagatgaacatccggaattgccttcaaagtaacatttctgaaaattccaaaaaatctgaaaaagtcctgatcctctaaaaatgccgccgtgctcatcttatgtacctgcactgcaagaacatttcccttttccttaacatatggtgtcagatcaaactcagaaggtgtgaagctgtcctctgcataacctataaacttaccattaagccacagatacatagcctcttctacaccttcgaagcatatatggattctttttccacacatgttcttatccaaatcaaagtatttgatataagagcctaccggattatactgtgcttctgagaacattccttcttctgctccggttgcctccatactatatgctcctctgtggtactcttttccttcccacggatacatagtgttgatgtaacgtattttatcatatccagccagttcaatatgtccggggaccataattttatcgaatccggatgcatcaaatgtttccttataaaaatcaacaggtctttccatcacatttttgctgtaagcaaactcccattgaccatttaatgactgtaataatggatttttttcttttttcatgtcagaataatccagataatagcaatgatcactatgtggttccaattgatttaccttaaacacttccggattatcaagccatttcatatcagcgttcatatttttcctcactttccaattattaatatataaaaccaagaacaataactgctttgctacatctaagatataacaaaacccttgcaaagagcaatgtaataaattatacaaatcatgcactaaatgatactgtgcattgcacagagatctttttagtccggttagtacagacatatattaatacgcgaattatatgatgacacttgctttccctttttttcaaatctttggattcttgtaataacctgatattccatctgcagcttgtccgatgaacaagagtatacacaaggttcaaaaccggtatattcatcatccccttgcgtataattattcccataataaaaattctctattatatttgtctcaaaggaagaatctatttttgattctgactcttttggatcacccatagaataatcactgccatatgtctttgcatataaatctctcatcactgcagcctgtgccttaggactatccacatctgcacaataatatgtaatataaaacggtactccaagcaccgcatcaacagcggccagcattctcgtatcttcaaatgatattataaatatccacgccgataattccttgcttatatccgatgttacaaaataatctgatattgtgttgtcaatactatcatccaaagtaactgctgcaccatattgccaaggagctgcttcatatgtctgttctgtttcgctgtctgtatcctttgaatagttactttcaaggctttggagcataactatatcgtcttcaccgagtatctgcataatacctgactgcttctgcagctcacaggcacccttcagaaaagtctgaatagccgtataagcctgtcccaccggaatctcagtatccaacggttcccttttctcactatatttcccattccacagctcatttacattgtcctgcatcagagacatcatctttgtaagcctctcttcagctgaaatagagtggctgtaggggcttatatctgcgttgcttatcgtagtactcgttttggcaatttttgctgctttaagtgaaatcagataattcggtatcatatttcccgcacatacaactaccagaataatgcatatacacactattcccttgattttatccggttttttatcaatacatttgcgcactgataaatgcttacttctcatccaatgcctccgctttcatgtcaaaatacaccctggttcctttacctgactcactctcataatggatttttgtatcatgcagcttagcaatccttgatacaagtgcaagcccaagccctgctccatgctcacttcttgatcgtgacttgtcaaccatataaaaagcctctgtaatgcgctctatatcctcaggcggtattcctcttccattgtccgaaactgcaatacgataaatactgtgcgaaataagtctgcctgatacctctaccttgctgcctcctgatttcactgcattgtctatcagattaagaagcatggtcttaaacagatcatattccagccacacccatgcctcatccgcactgtacacaatctctgtattatgcttttttgccgcttcatatgcggtttccacacagtctgctataatctcagatactcttgtttcttcaagcctgaaatcatttttatcaagagtgataagctccagcagcttaaatgataatgcttcaagcctcatgccctcattcagtatgactccggcagcactgtgcacctcatcctcagacagttttttctgatacagggtatcggcatatcctataattgatgtcattggggttttgagctcatgtgcgaagtttgcagtaaaatcctcctgcttctttgccgccatctgaagttcataaactttgctttcaaggtttttcgcaagctcgttgaaagcctttgcaagctcacctatttcatcctttgtcttcacatcacttcttgccgtgtaatcgccatctgcaaattttttggtggtggctgttaatccggcaagaggctttgtaatcatccaggaaagtatcaatatgaccatcataccaacagcaagtataacaatgtagtacacgctgcatctatacctaagctcctttgactcatcgaaaaccggtgtaatatcactttccgttatcagaatatacctgttatcattcagtttaaagctgcttttgacatggatatatctgctgctttgcttttcaccggtatctttagtattctcttttgacactatactgtatgtaagcgtaccatcctttacctttatatccttttgctcataattacatgaattggcatatatcctttttccatcatcatcagcaagatacattcctccttcatctccaacaatggattttgccgactgcgacatcatatctgtaagctccttatccacatcctcactcttcatattaaggattaccgtttcaatcgagtattttatcatctgatgctgtgaaagtgcactgtcctgctcccttttcactgcatgctccagcgaatatgatagagtcacatattctatcattccaagggcaacagccagtatcactgtcattccaagaaacattttatagaaaaatttcatccgcgaacctccagacgatagccaatcctgaaaactgtgacaatcttttcattccagtcaagctttttcctcagtctttgtacatgtgagtccagtgtccttgtctccccggtatactcctcctgccatacaagttcataaagcctgcgcctgctgagtgcaacattcttattcttcataagctcatacaacagatcaaattcctttactgtgagctctacctgctcacctgcctttatcactgtacgtgatttaggatctatagctacatcctctatttccagacgctctgccatgcgctgagtgcgccttaatacggtttccactctcgcaagcagctcccctatctgaaatggtttgcatatgtaatcatccgcgcccatacgaagcccgcgtatcctttcatccacctgtcccatagcagatattattatgaccggagtatccccaattctcctgacatagtcaagcaattcataaccatttatctcaggaagcataatatcaagcagcagcagatcatatctgttctgctcaattttgtccgccccttccttgccatcaaacgctctttcgcattgatatccctctgccttcagggtgttgcatattaaattatttatgtcgttgtcatcttccactatgagaatactggtcataagctgctcctcttctatgattatgatagaattattatagcataaagatgtgtcatagttgtaaaaaacaccctgttatttaactcaataataggatgttttaccggcacttatacaaatatattctcacacatacatactccagacagctctaatctgagatgatatatttttgaataaccaccttttgccacttttttcaatgctgtttggatcatttattgaaaatccttcatcatcatagcctgttataaccataaaatgccctgtatcggtaaaatctcccggtcctacatttaccacaataggatgtccttcatcaagctctgctttcattctgctctcatccagcgccactgcctttgcttttacgccgtagtgcatgcagccttcacttataagtgtccatgaacttcccgatccatccacactgtaaccggcttcctttgaatactttgctactgcaataggtgatgcctccctattgtgcgtcagataaaccactaccatcgaaagtgtagtgggaccgcatccgcttgctgcaaagaaattgccgctatatttttcgtagccccagcgtttatcccactgcacaaataacggaacactatccatagacgcttcttctgtcaaatcaattgtgtgttccttcacatgttccgccggataatcaaacacaaactcaagtgcctcttcattcttcaaagcaaggtcctttagctgttttggatattgggtactgttcattatatcatcaagcatcgactgattattttgtatcttattcttttcagagattttgctattttctataacagcattatcatatgtattatttccggcttcaacatcatatctatttgtcctgccatcaccggatgttatcatacggattccaacagccacaaatacagccacagctatgatactacaggaaaatatgataaaacgcagtatctttctgcgcctgcatctccttcgacgtaaacttgccccatgtctgcaacatttgttttgtgtcatgtccactttctaccctcctgcttctttgtaactgatattgtgtatcattactctatcaaaagcattcgtttattatgttgcatacttgtgtcatagttgtaaaatattccaatattaaattgtataaataaactgaccaatgacagtattgcaggatattttaacctgtcactgtattaagcaacttttgactatatattctgttattttggcaagtaataattcttttcgtattctataatgacatcgtaaacagaaaggagatgaatttccatgagaaataaattacacaattttattaataacttacttagcttttatgcaagcttctttactcacagattttatcaaatgtaatgtgcatagcatacataaaatacctgatgtcccccatatccttccactaaagctatgagctgcattccagttttcttcatcctgcaatgtccatacgatcctgattcctatcgtattgttctgcttaatctttggcaggtaatttcctataacaataaacttgttccataatagattaatgctataaataactcctctgtttctgctctttcacctcagatacctgcgactttatctgctcacacttggtataaaattgctcctgtgcctctgataatacctttttagcattattggtaatgggtaaaaaatagccatctagattgttagtccaaatgacctatgtaaaaaaatattattttaatttattgtaaagaactgtctctattcctgttattaaatctgtttttttcttataaagaagcgtccatgatgcctgattcttagaataatccatcttttcttctggaaaaaatgaacggcagaaatacttatctccatcatcattagataagaataaaaataaatttctgctttccattttattttccgtaaggtaatcagcctcaatcattgaatacatatttgcctttttattgtatttaaacactgtatcattactatctatcatttgttcaagtaatggcaaaaaatgtattctttgctctatctttttataaaaatcagatgattctattttctcaattgcaattgttccatctgctatttcatcaaatactttgcctctgtctctactcaattcaggtctatcaacaagatattgcagtcccataagatgaaaacaatcttttttgtcaaataagattcttaatgtaactgcaacaccttttctgcccaacacaagctcatattctgtcgataatagcggaataaaggcatttatacaatctataacatttctcattacagttctccactacttcttaagattaagaaaggctctgcaaaagcagagcccttctaacattttctttcgaggattaacctctagccagattgtggtaaatgttaaacccttataaagctcataaggcactgctctctggcacaacaccttactttaccgcttggcagacactcaagttgcctgtctttaatattatattacctgtcatatgaaaatatgtcaatccaaaattttatgttctacaaaaaatctgtagacatctcgtagactttggcttaggattaacacgtaaacttggtagacataaaaaataagagagccttcggatttctccaaagactctccaaaaagcccataaaatcaagctttctatttagaatttgccctcatcagcagcctgctgaacagaaacggctactgctactgtagcaccaaccattgggttattacccattccaataagtcccatcatctcaacgtgagccggaactgatgaagatcctgcgaactgtgcatctgaatgcatacgtcccattgtatctgtcataccgtatgaagctggtcctgctgccatgttgtctgggtgaagtgtacgtcctgtaccaccgcctgatgctactgagaagtacttcttgccctgctcgatacactctttcttgtatgtacctgctaccggatgctggaaacgagttgggtttgtagagtttcctgtgatagaaacaccaacgttctcgtgatgcatgattgcaacaccttcctgaacatcatctgcaccgtaacacttaactgttgcacggagtccatctgagtatgcatgctcagaaacgatgttgagcttagctgccttgtagtcatactgtgtctctacgaatgtgaatccgttgatacgtgagatgatctgtgcagcgtcttttccaagtccgttaaggataacacgcagtggtttctgacgaaccttgtttgccttctcagcgattccgatagcaccctcagcggctgcgaatgactcgtgacctgctaagaaacagaagcactctgtctcctcctcgaggagcatctttccaaggttaccatgtcctaaacctaccttacggtgatcagcaactgatccagggatacagaatgcctgaagtccctctccgattgctgctgcagcgtctgctgctcttctacatccttttttgattgcgattgctgcaccaactgtgtatgcccagcaagcgttctcgaaacagattggctggattttctttacctgatcgtaaacatcaagtccagcgtcctttgtaatcttttcagcttcttcgattgagctgataccatagctgttaagtacagcattgatctggtctattcttctttcatatgcttcaaataatgccattgtcgttctcctttcctcttattcctgtcttggatcgatgatcctaacagcaccctgctctggagttacacgaccgtatgatcctgaagctttctcccaagctgtgttagcgtcatcaccctttttgataaaatctgtcatttttccaagagaaacgaactggtatccaattacttcatcgttcttgtcaagagcgattcctgttacatagccctcagccatctcaaggtaacgaactccctttgcctttgttgcgtacattgtaccaacctgtgagcgaagtccctttcctaaatcctcaagtcctgctccaacagcaagtccatcatcagagaatgcagactgtgtacgaccgtaaacgatctgtaagaataactctctcatagctgtattgatggcatcacaaactaagtctgtgtttaatgcctcaagaattgtcttaccctgtaagatttctgctgccatagctgcagagtgtgtcattcctgagcatccgatagtctcaactaatgcctcttcaattactccattctttacattgagtgagagcttgcaggcaccctgctgtggtgcacaccagcctacaccgtgtgtaaatcctgaaatgtcctcaattttcttagaatgaacccattttccttcttctgggataggagctggctcatgttttgcgcccttagctacaggacacatgttttcaacttccttagtgtaaatcatcttaagactcctttcgttatggttttaacatacccgatttattctctcatattttttgtcataagtctagagtatcatcgacaaaaaacaacaaaaatacaatattttttcaaacaacattactattttttaagaactacgttgtccttgtccttgaaaatgtggtttgcaggaatgactccgcgtactcttgaaagcggataaatgtttgaatttcttcctattactgttcccggattgagaactgaattgcagcctacctccacatggtcaccgagcatagcgccgaatttcttgcggccggtttcaatctcctcttttgtatcgtaaacatcctttacgactacaagagtcttgtcactctttacatttgatgtaatagagcctgcgcccatatgtgatttgtagcccaggattgaatctcctacatagttgtagtgtggcacctgtactgaattaaagatgatgacatttttgagctctgtggagttacctactactgagccctttcctacgattgcgctgccacggataaaggcgcactgtctgatttctgcatcctcgcagatgatgagcggaccgtgcagatatgcgctgtcaaatactgttgcgctctttgccacccagatatcctcgcctcttttttcatagatttcagggtcgagtgttggtccgagctccttgatgaaatcacttattccggcaagtgcctcccatggataagtgaactgtgataaatactcctttgcgattgtttcatccagattatagaggtttgttatttttgcgttttccatttttctatgtcctttcttttatttattatgtgaaaattattgactattgttttaactgtcattttaatatttaaacttaaatataagtattaaacataaatataaaaattcatattaattatagatttaataattaattataggcaaagctactcaccgaacagctcatgcgccgccgcaagtgccgcctccgacacatcatctgcctgtgcactatcagctgccatatcaaatcctgccagaaattcctctgggattcccatctcatccatggttgtattattcatggttgtctcatccggaacatcatctgccgtgctctgtacttcagcattgttatgtgtatcagcattgttatgtacttcagccgcgctctgcacttcttcctcgccggggttatcgaaatcaaatgatatctggtcattttcaaacttaaggcatgtatcgaatacatttcccgcctttgaggtgaagcctgtgaccttctttttggtctttcctgtggtaaacagctccgtgagaatttcctctgaaagctccacctttgccacagtatgccaaacattgaagccgcactcacactcatatttccactgtgtctttttgagaggtctgccacactttggacagagtacatttgtctcgattggcttaggcttttcggggaaatcaaaggctatatctccgtcttctgtgagctttagcggtgcgtcaaacttcatgcctgtctttgagacaaatcctgatataacttctgtctttttctttgtcagaagctccttaaggactgattcctttatcttgacacttgcgaccttgcccaccataaagcggcagctctcaggatcatcacgtctgttgttctcgcatacaaatccaaacggcgccacctggattttgcctccgcacttcggacatactacatccttcactgtctttggctctacatggtcaaaatcaaactgaacagagagcttcttgttttcatcctccttaagcaccaggcacgcatcgaagcgtttcccgcttttggatttaaagcctcgtatggtctcggtctttttatcattaagaagctgctttaagtttgcggctgtgattgtctttcccgcaatctgtcccaccgaaaagcggcagcttcccggctcatcacccttgtagttcacacagccatagccaaacgatgtcttttttatctgaccaccacaaagcggacagacgacatcctttatgatttcgtcctccacattgtcaaagtcaaatgccacaactgtgtgcattttctcacttccctctgtgaccggctccttctttaagacgagacatgcgttgaagcgctttcccgattttgatttaaagccctttatcgtctctgttctgccgtttgccatgagctctaaaaactgtacctgtgacagctgcttgtctgctatccttccaacgaagaaatggcagccatcctctgtctgtctgttatagtttgcacatcggtagccgtatggcgacacatatatatcgcctccacagtccgggcatacaatgccctcgaccttttgtggctttacattttcaaaatcaaaggtggctgataccttgttcgtctgttcatccttgttgagctttaagcatgcatcaaagcgtttgccgctcttcgacttaaaaccacggattgtgtcggtgattccttcttcaatcagctttttgacctgttcctccggaatatcaagtcctgccacctgtccgatattaaaattacatcctgatttatcatttttataattagcacagccatagccaaacggtgtggtcactatctcaccgccgcaaacagggcacttgacacctatctttcgtctggccgccgcacctctggcatttttgcctgcaaagctgccgatacggtctgcaatctcagggcgcagattctgctcaatcatcttttctgtctctttgcggataaagctctcaagctttcctctgtattcccagaaatccaccgtgccccttgtaattccgtccagtcccttttcccagttggctgtcatctttggattaagaagtgccggaactgtcatgtatacgacctcaaacaccatctcgccaaggctttcgggtgtgagtatctgtgtctttttgttcagattcagatatcctatacggacaagcttctggattatctccgctctcgttgctgaggtgcctattcctgagccctttatctgctcacgaagctcctcatcctcgataagctgtcctgcattttccatggcaagcaccatggagcctgatgtatagcgctttggcggagatgtcttaccaaacttgatattatagccttggcatgctatctcatcacccgcctttagcttatcggcaagctcaagcatcaccttgggatttacgactatctcatcattgctgccgtttgctgtgctgttttcatctgtactatctgcagtttcactgtttttaccaagtattcgtgcgtttgattcctcaaacgacttctttttcggcggattcgccacctgtaaatagccctcgctctttagtacctttgatgatgcaaaaaaactttccttatccacatctacgacaagcttcacattctcatactctgccggtggataaaaaatactaaggaaacgcctgacaatcagctcaaatactgctctttgaagcgatgtaagccccgaaagctctgttagctgacctgtcggaatgatagcatagtggtctgttaccttgctgtcatccgtgtactgcgtatcagctatgttggcatatagcctcttttgcataatatgctccacaaagtctgctgtcggttcaaaacctttaagcctgcttatattttttccaatctcctttgccacagcgcttgagagcaccctggcatctgttctaggatatgtggtgagctttttttcatacagatcctgagccacctgtaatgtctcatcagggctgattttaaacttctttgagcactctgcctgcagctccgccaggttgaaaagaagcggtgctctttttttagcaatattcttaactatagatttaactttcgcctgtttgccgtttaattcttcaattaaagcaagtgcatctttttcctctttgaatccgttttccttgtataaaagcggtgattcaaagtaccttgagccttctacagccttccactctgcctctacaccggcatccgtaaacctgccgattaccctgtaaaacggagtttccttaaagtttctgatttcgcgctcacggattactaccattccaagcacacatgtcatcactcgtccgaccgcgattgccgtgtacgagcgtgtacccgctgcatcgtttagcagattgccgtatttgaccgacatgacacgcgaaaagttgatgcccatcgcatagtcctcgatggtacgcatgatgccgctctttccgaggtttgcatacgcactcatcggctttgcctcttttatgcctcttaggatttcctcctcggtctgcgaatctatccagactcgaagttcctccatgccttccctgacaccaccaaagtttctgatattctcctcgatggtctgtccttcttttccggcatcacctgcccagtaaactctgtcaatgtcctctctctgcaaaagagcgtgcacaatattgtactgcttgcgcacgctgtctatcacatcatatttgtattcctttggcagaaacggcagatcctcaagacgccatttcttatatttcatgtcgtaggactcagggtagaccagcccgaccagatgtcccacgcaccatgaaatcacatattctccattttctatataaccgtcattgcgtccgctcacccgcagcaccttcgcaaattcctgtgccacggatggcttctctgttattatcagtgattttcccataagctcctctataattcattcatgttgatgagcttgaatctagggtctctgaccacatagctttgcagtgcaggctcaaaatccgttgccgaaaacagataatagtcatcagatgtaagccttgcctgctccatagccatagccatattctcgcacatatccatggtcatcattggcttgtcccagttgcagaagccgatgatactccttctatcctcactctgagccacgatgtctatgcggcctgtctttccaatccatgtacccacacgctttatggtaaacggaagctgtcccatctgatttaatataagcagatactctgtgcagacctccctgaaatatctctcaagatacgcatcaagctctttttctatatatgtatcataaaactcttccggtgaaagcagatacagattagacatattcggataaacgaacttaaaccagaaattaacaaatgtgtcttttatctgatatacgcccttctttgcattttcccatccgccggtctcaaatgaaactactttttccacgatattgaagttggcaagattctttaaatatacgctgattttggcacgtgaaaatcctgtcgcatggaaaatatcattgagcttgttctcgcctcttgcgattgctgcaagtattgtactatatgctgaaagctctcgaagctctgcggatataacagcatccgcctcaccatacagagctcccgatggtgtcaatacgagcctgcatatattatccttaaaggatttagctgcatcccacttatccagatatgccggaactccaccgattgctccgtaaattctcacgatttccgcgaccggaagactttcaaaatgtcttacaacctcaaggaaattgagcgattcaagcttcatttcggctcccttaaactgctctgctgcctcctgtgtggcccagactgtagatgatgtggcaagtattataagcacaggtcccggatacagcttgtgctttttaagctttgcaactgcttccataaatgatgcatccctctttgccacaaactgtgcctcatcgattatcacgacaagcttggaagggtctcctgatttgattctcgcgaagtactcctcatatgtctgtctgctcaggctcaccttgtactgacggcttatctcctcccccatcatctcaagctgatgctctggcgatgcctgtctgcatctgtagtaaaagaatttctttccgtcacaaaattcctttatgagctcctccttttgacagcctctccttccgtagagcactacgagctggttgcccgactctttatagagctgctcaagtttctccaaatctgtgtgttttgctttcataatattcctccaaaataatcaactgaaaatattatatcacaatttaacacatatacaaatagattttaattataatttccgagctcctattgtagctttcactttatttctgacaaacatatagcagatagcctgcatgatgattgtcgctatccatgaaccgggatatgatataaacaggaaaaacaacgacctgtggcttggaaacagaccatatatccaaatgattctgactccgactgttcctattatagaaagtatcataggtactgttgagtatcccattcctcttagtgctcccggaaaaaggtccatgattccacacaggaaatatgggattgttgtaatcgaaataatctcaagtcctgatttaattaccttgctattacttgtatatatgccaagtatctgtgttccaaatatgtatgaggcacttcccatcacaagtgctaccgctgtcgtgagaaacagacagtctatcagtaccctgtccattctcttttgttttcctaccgcatagttctggcttgtaaagctcatgcaggcctgtgtgattgagttgacagatacatacaaaaaaccaagtatattgtttgccgccgtatatcctgccatggctattgagccaaaggaattgactgatgactgcagcatggcatttgagatatttatgactgtgctctgtatgccggccggaattcccacctgaaatatctgaagcatatattccttatcaatcgcaagcttattaaagcagagcttatagctggtatctgctttgctcaaacaatataatacaagcacgctggaaacaaactgcgaaacaattgtaccgattgcaacacctgcaacatccagtttgcacactattacaaaaaacagattgagcagtgcattgatacagcctgaaataatcaaaaagataagcggtctctttgtatcgccgacagcacgcaaaattgccgcgccatagttataaagcataaaaaacggcataccacaaaaataaatcctcatataaatagtggaaagacctatgacatcatccggtgtacccatgatttccagcgcaccccttgcaaaaataacaccgaccacacccatcacaataccacttatgagtgcaatcataatagaggtgtgcaccgtcttagacatctcctcatccttgcctgccgcataaaatctggcagcgagcacattcgcaccaagcgatatacccataaacaaattgacaaacacattgataagtgccgtagtcgagccaacagccgcaagtgatttgctgccactaaactgtcccacgacaataatatccaccgcattaaacgctaactgcaaaatacccgaaatcataagcggcaacgcaaatgaaataagcttatccattattgaaccgttcaccatatcaatttcatacttattattcttcacttatatctacctcttaaaaaatattctcctcagcctatctattttaccacgataaaatataaattcaagcgtaactatttaaaacaactgagaataaaaaagcccaaaaaagagagcctcttttaagaggctcgacttttgcataataattaattcacagagtgaggattttccgttcaatacactgccttcaccggagagtacacagtatgttccgaagaaaaaatatgaactgccacgggtttccaataggtcaaatgaccacatagacctgcaagctgccatagcctatccataaaaaatcccgtggctgacttcatattttatctgaggaatactactgtgtgctaccccggtgcccacagcccacaaacggaaaatccgccctcattaataaatattccaatgaattgccaactctacttctttgtgatataaccctgtgccttaagaagttctgcacaaagcactgctccaccggctgcaccacgtactgtgttgtgtgagagtccgacgaacttccagtcatagactgtatcctctctgagacgtccgacattgattcccataccatgctcataatccacatcaagtgcaacctgaggacgattatcctcttcacagtatctgatgaactgctttggtgcgcttggaagtccaagctcctgtggtactccactgaacttctcgagtgcctcgatgagctgctccttggtagggttctttttgaacttgacaaatacagctgctgtatgaccgtttaatacaggaacacggatacactggcatgtgataaccggtgactctgcaggaacaatctgtttcttctcatcatccacatatccccagagacgaagtggctctttctcagatttctcttcctctccaccgatgaatggaatgatgtttccaaccatctcaggccagtccttgaatgtctttccggcacctgagattgcctgatatgttgtagcaacaacctcatatggctcaaactctttccatgctgtaagaaccggagcatatgactggattgagcagtttggctttactgctacgaagcctctctttgtaccgagacgctccttctgatatttgataacctccatgtgctgtgggttgatttcaggtacaaccattggcacatcaggtgtccatctgtgagcactattgtttgaaactacaggagtctctgtctttgcgtagtcctcctcgatcttcttgatctcgtcctttgacatatcaacggctgagaatacgaagtcaacctgtgaagcaacctcttccacctcattgacgttctttacaatgattttcttaactgcctcaggcattggtgtgtccattttccatctatcaccaacggcgtcctcgtatgtcttgcctgcacttcttgggctggctgcaattgttgttacctcgaaccatggatgattctctaaaagagaaataaatctctgtcctaccattcctgttccaccgaggatacctactttaagcttttcactcattactctaatctccctatcttctagattttcttcgaccatgtcatacactatactttgacattaaaatcatgttttgtccgtctgtcgcgtacaactgtctttataggaaatatattacttgaaactctaatgaaaaacaaggaaaaaactatattaaattaataatttttctccctgttttttataaaatatgcacaaaaactacacttcatcctgccaatttgacttcatatactcgtcgtaaacggcaattaccttgtccattgatgtctttgatggcgctccaactgtacaccttgtgctgacacaggtctccattgaaatggcatcaaatacatcctcctcaaataccggagagatagccttgagctcgtcgatgctcatatcgtcgattgcaatgcccttgtcgatgcagtaaagcactattcttcctacaataccgtgtgcatctctaaacggtacaccctttttaacgagataatcagctgcatctgtggcatttgtaaagccattgtttgcactctttctcatcacgtccttgttaaacttcattgtatcaatcattcctgtaaaaagtgcgatacatccctttgcagtgtcgaatgcatcaaatgccagctccttatcctcctgcatatccttgttgtacgcaagcggaatacccttcatggtggtgagaagcgacatgagcgcaccgtatacacggcctgtctttcctctgacaagctctgctatatcaggatttttcttctgtggcatgattgagcttcctgtgctgtacgcatcgtcaatctcaacaaactggtactcgtttgaattccatatgataatttcctcagaaaaacgtgacagatgcatcataatagttgaaagagccgataaaaactcaatcagataatctctgtctgacacaccatccatactgttaagtgtcggtccgtaaaaatccagaagctgtgctgtatagtccctatcaagcggatatgtagtgcctgcgagtgctcctgagccaagcggacaatagttcattctcttatatatatcgcacagtcttgatctgtctctcttaaacatctcaaaatatgcgcccatatggtgagccagagtgattggctgggccttctgcagatgtgtaaagcccggcatgatagtctgtgtgttttccttcataatcttaaggataacagctaaaagctccttaagctcattatcagtctccttcactgtctttctggtgaaaagacgcatgtcaagagctacctggtcgtttctgcttcggcctgtgtgaagcttctttcccgtgtcaccaagcctgtctatgagtgtagcctcaacgaagctgtggatatcctcatactttgagctgatttcaagctttcctgactctacctccttaagtatctgctttaggcaagccactatatcattgctctctgcctgtgagatgatgccctgctttccaagcatcgtgacatgggcgatgctgccctctatatcctctttataaaacttctgatcaaatgaaatggacgcattgaaattgtaaacgagctgatctgtctcctttgtgaaacgtcctccccataactgtgccatgagattcctccttgattattaaatgatgatttattttcatgtatcacaatgtattatataaaaataagatgtgataccgccgtctgctctaaacagccgctttactgtgctaaattatataataatttttgctgtcacgcaaccacattttcacccacgtgctgcaatctctctgtcacgctgttccttggaaaatacacagccgcagtagtactgcctgtacatatcatactgctttgatatttccgtggactttttatagccctctttcttcttaaaatcagagaaaagatatcgcactccatattggctctctaagtcttttcctatctcattgagcttttcggcattcttcaacgggctgatggaaagtgtcgtagtaaaaaaatcaaagccatgctcccttgcatactgtgcactctcctcaagacgcagcctgtagcacttaaagcacctctccccgccctcaggcacagcctccatgccgcgtgccatatcgtaaaagcgcctggtgtcgtacacaccctccacaaagtgaaccggatttttcaccggaaactcatctataaagcgcttctgttcctgtgctctcatgtgatattcctctggcggataaatgtttggattgtaataaaataccgtcaccttaaaatactccgagagtgtctgtatgcagtatgtgctgcacggtccacagcagctatgaagcaaaagacgtggagtgcagttattgtccatgcaattttcttttattaaatcttccattaatttttgataatttattttatttgccatattatattatttctttctcaaaattcaaatttttttgacatatcccaaaatattatttcaggtaactattctgcatatttactattctgattaattactatttctgatataagctgcataatacgaacaagggccggaagtctcctcccggcccggctcatactaatcctcttcttcatatccgaacattagtctaaaaatcttttttcctgtttcagtcttgaatatgtgcttgtatgccttgtcgattgcacggtttcccgcatcatcctcatacagatttacgaggaaatcagcctcaacgagtatctgataatcaagaccatctatattgtcatatgtgtgatggtgacctatgagaaaacaaattctttcaactatgtaattctcaaagccaagctgtgagagcatcttctgagcgattatcggtccctcctgctcctgaagctttccatcgcacctgccatacttctcctccgccacacgtatgccaatatcgtgtgtgtaagccgctgcctcaagtataaagagcgaggcatcatcaagctcctctcctataccgataagccttgcatagctgtgcaccttggtgaaatgctggattctctttggatcgccatcatagtaggcaatcatatccataaacaagtcgtctaactgttgtttactataactgtcactatccatttaatatatttttctcctgataatatgttaattagtagcattgccgactttgcaccgacaatgataacatactacaaagcgatcattttttcaatatttttacacaaatatttcttattttttgcgaacactactttgcatcacggaaaaatcccctgaatgcgaattcagacaaaggcttcttgtaaagcagctctcctatcaatatctcaagcgctccacctgcaaaaatagcaatatagcctagcaatgccaccaccgggagtccaagcttaaaaacagcattagaaaccggcacaaacgctgctcctgaaaacacagtaaaaacgcccataaacaaaaccatgaatacgataaagccaagtacataatacttatagcatatgcttgtgtacagatatactgtcaacagctcaacatcgagtgtaaaaagtgtgaagataagctgtttcttatctgctacggaattctgtatcagaatgactctttctattaccaaaaatgtgaaaacaacaagattgattaccgtgcttgacatcaccggaatgtatatctgcagcttctttttcagtgatgtggactggataagctctgacacatccatcgacatgatgagctggaatgtgaacataccactcatcataaagtatatcccgcctatgattgtagttcctttgctcattatatcggatgcaattccgaatactgcaaagaatacaagcatgatcacattcagcttcagtttatagccatatctcaataatttaaatcctaatttaatatctttcagcataatatttctccttttcaaatatacttccaatttaaaatacctctacacatcaacatatgatctgcggatacgcactagcatatgataatatgtcgctgctatcactcctacaagcaccactgctaacacaggtgcgataaaccaaatttttgcgccataaatcaaaacagctatactacccgcaattgccgggaagataactataagcgccagcagataaatatacattcccagatccatgtatctgaatatatttaatgagccaaccgaaacaattgaagatatcataataatgtcaaatatcgaccaaatattaattccaaatttaataaatggcattgaagcaatgagtattgtaattccaatacgcagcggtcttataagtatatccacaagaactgcattctcaaagtatcttactccgttaaaacctgtctttaaaaaatgcatgccaaatgcattctttttgcacatacagccaaagcagaaatagtcctgcaccacctcgcacatcatataaaaatcataaataattactataactcctatccatgcccagactgtttttgaacaggcaataagcattgatgtaaaaattgccaaaaacggaatcagtatatttgttataagacgatacttgagattagtcataacacggtaatccctgatgtatgttagaacttcattctttgctttgttatcttttttattaattgttctttcagtatcattttcctgtgaaaacattttttcattcatacttcctgactttttttccataacaccttacctcgcactagcgcatcacaatctttgtgttatttttcatgactgcaacgcttatctggtaaagtgtcggaatctcctttgtcacattaagtcctgcgagcttatctatgttttccgccaagcatatgccctcaaagccatacggatttttggtcattgaataaagcaccttaccggcagtctctgtatctgctgcatctcctttaatcaggatgtatttttccttcaaatcctcaacaaagccctgctccacaatctgtccgttttccattataatggcataatcggtgatattttccatatctgaaatgttgtgcgtagagaaaaatacgctgcgctttccgttgccctcatggatatactcgccaatcatctggcacagcttatctctcataagcggatcaagcggcgatgccggctcatccagcaaaagaaggtctgtctttcgcgccatgacacctgccagcatgagcttcatcttcataccatccgaaaatgagctgttggctttcttcatatcaatgctgccatgtgaaaatattgcaagctcctcacaatatctgtgaaaatcctctgcagaaaaatcatcaaacatcagcttgctgatttcctcaatatccttaactgtccactgtggcagatagtatttgcccggtcctgtgtagcctatgcggtttttaatatctcccgagttttccttctgtttatcagaatactgtccgaaataagtgatttcacctttatagtcaagcctgattcctgccaggatatttaaaagtgttgtctttcctgctccgttttctccgattaaggctgtcgcaaagccctgtggtattgcgaaattctccacatccagtgtaaaatttttaagttcctttgtgatttttgctgcctcaattgcattctttgttgtcattttcattcctcctgactcgtttcatatctttatttatccacctcaagcaacgcctcaagcattcccttaagctcgtcgtttgagattccggccacctcagccgcggctatcgcgtctgtcagcgactcctccaccttgcgcaggtgctgttcctttatcatctcactgtcctgtgcattgacataaaagcccttgccctgcgccgctgtgatgagtccctcatctgcaagctgctcataagccttcatcgtggttatcacactgattttcaggtcctttgccagccctcttatcgacggaaggaactccccctgctcatacctgccggccaaaatatctgtcttgaagctgtccgctatctgctgatagatgggcactcctgaattttgcatcagcttcatatgctacctccgtactgtatttattaactgtttatgtgttatatatacactatatacattttaatgtcaatacctttctataattatctctctaaaaatttcacctcaaaattttgatttgacatacactcttatatctgatactataatatagcttgccgatatggctcagtaggtagagcgacgcactcgtaatgcgtaggccaccggttcgatcccggttatcggcttcatacataaaaaacacctcattcaaaactgaatgaggtgtttttttattacaaaaatccccttgacatttataaaaaatatattaaaattatctcgttggtttatttttagtaaacaaaaaatctattattaaacctacagtaaatataacataaaatgtattagaaaaggaagtaaacatggatatcggacatcgtatgaaggagcttcgtatccagtacggacttacccagcaggagcttgctgacagggctgagctgacgaagggatttatctcccagctcgagcgaaatcagaattcaccgtcagtcggcaccctgcttgatatcatccagtgcctgggtatgacgccggcggagttttttacggattcggaacctgagcagattgtatacaaggcaaacgactatttcgagaaaattgacgaggaaaaaaacagcaaggtggaatggatcattccaaacgcacagacccgctccatggagcctgtcaggctcactcttcatccgggtggcagttctgaaatatatctgcctcaggagtgtgaggagtttggatatgtgataaagggcacagtgaagctttgctatggtggcaaggtgcacaccgtaaaggccggtgagtccttttattttaaagccggcaagaagcattttattgaaaataagtcttcaaaggatgccatgctcatatgggtcagcaatcctccaagcttctgacgcttcccctgcagaagctcttttatggggctgtaattactgccggccacatttttagtgtgtacagcagcaaattataaacatacagttcctaccaatactataattacatgagaaaggtttacaccatgggaaagaaattaattgattttatcgatatcacaaagtcatacaacggcaatgttgtactcgacgatttaaatctatacatcagggagaacgagtttctgacgctgcttggaccatcaggctgcggaaagaccaccacacttcgcatgctcggtggctttgagacaccggacaagggaaaaatcatgtttgattcaaaggacatcacaaatgtgcctgcaaacgagagaaatctgaacactgttttccagaaatactctcttttccctcatatgacaatagctgaaaacatcgcgtttggtcttaaaataaagaaaaaaagcaaggcttacatagatgacaaaataaagtatgcattaaagctcgtcaatctcgacggctttgaaaaccgctctgtggattctcttagcggaggccagcagcagcgtatcgctattgcaagagctattgtaaacgagcctaaggtactgctgttagacgagccgcttggcgctctcgacttaaagctgcgccagagcatgcagtatgagcttatccgcttcaaaaatgagctcggtatcaccttcgtctacgtcacacacgaccaggaggaggcgcttaccatgtctgacaccatcgtagtcatgaatcagggctatatccagcagattggcacaccagaggacatttacaatgagcctgaaaatgcctttgtcgctgattttatcgggcacagtaatataatcgacggtgttatgataaaggataagcttgtcgagatactcggtgtaaagatgccttgtgtggacgagggctttggtgagaacacgcctgtcgatatagtcatccgcccggaggatgtggagctggtgcctgcggaggacggctacatgcagggcgatgtcgtgtcaaatatcttcaagggagtgcactatgagcttgaggtaaaggcaaacggctacgactggatggtacacaccaccaaatatgtagaggtcggcagtcatgtgggtatcaaggtgattccatttaatatccaggtaatgcacaagcctgagtcctcagatgaaaaggcggtggagatagatgtctaaaataaagaaacagctgctcgcagggccgtacctcatatggattatcggatttatcatacttccgcttttcatgattgtgtactatgcatttaaaggctctgacggaggcttcacatttgaatatgtggctgcaatagcgcagcacaccaatatcaaggcactgcttttatccctacggcttggagtaatatgcaccataatatgcctggtgctgtcctatccgcttgcgatgattttaaacggcttaaagattaaaaaccaaagctttgtggtatttgttttcatgcttcctatgtggatgaactttatgcttcgaatactcgcatggaagcagcttttgtccaaaaacggtgtcatcaactcgatactcaccactctcggactgccgggcttcaacatcatgaatacctccggagcagtcgtgcttggcatggtctatgactttctgccattcatgctgctgcctatatacaactccatgaccagaatcaaaaacgactggattgaggcggctcttgacctcggtgcaaacaaagtcacaatacttttcaagattatactgccacttacaatttccggtgtcataagcggaatcgtaatggttttcgtgccatcactcacatcctttgccatctcacagatactcggtggcggcaaggtcctgctcatcggaaatatcatagaacaggatttcgtccatggctcgcagtggggcgcaggaagcggtctctcactcgtgctcatggtattcgtattaatcagtatggcactcgtcaatctgtttgataaggaaggagaccagagcgcattatggtaaaaaaaatagcatcaagggtatatatgggactgatttttttgtttctgtatctacctatcgttgtattaatagtactctccttcaacaactcaaaatccaaggttaaatggggaggcttcacgctcgactggtacataaagtgctttcagagtgagcggattatgtcggcattttctacaacactgcagattacgctgcttgcagctgtgatttctacaataataggaactctcgcagccatgggtataagcgccatgaagaaacgtaaccagacaatctatctgggcgctacaaacatcccgatgctcaatgcagatatcgtgaccggtatctcaatgatgcttttgtttgtaaaattcatgaatctgggctttgtgacagtgcttatcgcacacatcacgttcaatatcccttatgtgatactcaatgtgcttccaaagctcaagcagaccaacaaatacacctatgaggccgcacttgacctgggcgcatcacctctatatgcatttttcaaggtcacctggcctgaaataagccccggagtgttctccggctttatgatggcggtcacaatgtcactcgatgacttctccatcacctactttacaaagggtgcaggagtaaacacgctctcaaccatgctctacacagagctgaaaaagggtgtaaagccggagctgtatgctctgtcaaccatacttttcttcacagtgctgttgcttttggttgtggtaaacatcaactcaaaccagatacctgtcagcgcatcaaagaagcctgcaagggctaaaaagctgcgcatcgtaaagcgtagtgtgagcatcgcaattgtcgcagtactcgtaatcggctgcttttcggtatttacgataagcgccggaggcacgaacaatgacaatgccataacagtgctaaactacggtaaatacatcgatgaatcagtaatcgacagcttcgagcaggaaaccggaatcaccgttaaatacgaggaatatgaggagcctgaggagatgtacacaaagtacaagtccggtgccatcgattacgatgtcatctgcacctctgactacatcatcgagaagctcataagtgagggtgaggtcaacaagatagactacagctcaatgccaaactatcaaaatgtaaatcaggatataatcgacatgtccgcatcctttgacccgacacatgagtatactgtgccttatttctacggcacactcggcatactatacaataaaaagatggctgatgcatcagacctaaatacctgggactgcctgtggaacggcaaatacaaggacaacatggttatgattaattctgtccgtgatgcctttactcccgcccttcgcacacttggctactcgataaacgagacagacacagcaaagctcgatgaagcatttgatatactaaacaaacaaagcagtgatgtgctcgcctactacgtggatgaaacctgtgatgagatggttgctgaaaatgcggcaatcgcagtgtgctactccggtgaggcagctgcagccatggctgaaaacgataacctggactatatcgtgccaaaggagggctcaaacctctggattgactcatggtttattccaaagacatgcaagaataaagagggcgcacaggaatttttgaactatatctgcagtgatgagccggcacagctcaactttgaatatgtatactatgcatcacctatccagtctgtcatcgaaaaccaggatgcagaaacgaaggaaaatgaggcgattaatcctccttccgatatgctcaaaaactgtgaagtatacagagctttaaatgatgatgacgcaacactttacaacacactgtggcagaggctcaaatcagattaaaaatggattgcgcagctgtattttgtatgatatcacaaaaatgaagtctaaaaattgtacaaaaatacatattgcaaacttcaacaaacaatgatagagtaaaacccacgaagcgccctgcttcgtgggttttacttttccacgagatccgatatttttatgctccgcaaggagattcatgaaatacacggagtttttacatactatagaaacagaaataaccgcaagacttgacaataatttcaagcttaccatccatcctgtcaaaaagaacaacgggatgatctacgacggattggtgattatcaatcccaaattcaatatagcaccgactatttatctcaatccttactaccattggtatcttgatggtgtatccattgattctattctcgatgcaattttatccacctacaatgatttcaagccaactgaagattttgacataagcttctgtgatgatttttccaaggtaaaggagaaaataattttccagctcataagctacgacaaaaaccaaaagcagctaaaggacgtgccctatatcaaatatctggattttgccatcatatttgaagtatatgtaggagcgcaactgcctgaatttggcaccattacagtcacagatgcgcttctgtcacgctggggcatagatacagaaacactaatccgcgcctcaatgcaaaatacaccaaggatacttccatgctcaataatcaacatggcagagtttcttgccaaaaaatgtccgggctatgccaatcagatgcgcgcagtctgtgattttgacagcctgcctatgtatatccttacaaacagcaggcagacaaacggcgcatccgccatactctacccgggtgtgctaagctcgctggcaaaaaagctcggcggcaatatgctgctcataccaagcagtatccatgaatttctggtaatgccgctggatagcgatatagatgtctgcaacctaagcgaattcatctgtgaggtaaactctacagaggtacgcgacgaggaagtactcggcgagaggtactacatatacgatagtaaaacagacactgtctactgataatcatataacccgataacacaaaataccggatatcatatcatagatatgtatccggtattttactttctaagaacatatttggaaattcatgaaaattattggcctgttatttgcagaacgatgtactagttgccaagcagcatgtcgtaaagcttctcatactctttcgcagatgccttccatgagaagtcatgcctcatggcgcgctgcatcatctcctgccatctatccttatggttttcaaacacatcaagagcatatttgatgacatgcagcatatcatgcgcattataattggcaaaggaaaagccatcgcccgtattctcgtactcattgtacggcactacagtgtccttaagaccaccggtctccctgactataggcagcgtaccatatcgcatagacatgagctggctcaagccgcacggctcaaaaagagacggcatgagaaatgcgtcacagcctgcatatatctcatgtgcattttcctctgagtaaccgatatatactccaagcttctgcggatacctgccatggaaataattaaacatctcctcgtactgctgctctcctgtgccctgcactataaactgtacattcatggtggaaagcatctcctccatcacatatgccaccagatcaaagcccttctgctttgtcagacgcgaaactattccaatcagcatgacatccttatccacagccagaccatacttctcctgcagctgacgcttattaacgacctttccactcaattcccttacagaaaaatgcttatccagatatgtatccttcataggattaaagacatcataatctataccgtttacaatgcctctcaaatgcctgcgccgctcaagcatcaggccatccaggccctctccgccctcaggtgtacagatttcatctgcatatgtcggactgacagtcgtaatctcatctgcatatactatgccgccctttaaataattagcctcaccatagaactccagctcccctgaattaaaaatatgctccggaagtcctgtaacatcagccacctctttaatcttccatcgcccttgaaacttcatattgtgaatggtaaagactgtcttgataccggcatagaaattgtctgagccgtatactgtctttagaaaaaccggcaagagtcctgtctgccagtcattacaatgtatcacatccggggcaaaatctataaccggcaaagcctcaagcaccgcctttgaaaagaaagcaaacttctccacatcctcgtatatattgttgtatggcttatctcctgcaaagtaaaactcattgtcgacaaaataatatgtcacaccatcatactgcgatgtaaaaatccccacatactgcctgcgccagttgagattgacataaaaatgacagacgaacttaagctgtggcagtaatttatcatccatacatttgtacttcggaagtataactctcacgtcatatctgtccttgtcaaaatatttcggtaaagatcccactacgtcagctagtccacctgtcttcatataaggtattgcctctgatgcggccattaatattttcattttgtccatgctgaaacctcccccagattacagttatttaaacaacgattaatctgataaaaaatatagtatacatcctgaaaccaatagaatgtatactatattatatcacgcgggagtacattttgcctagtaaatttatcaaaacgtggttttatttgtctataatgacgatttttacatccctagacgtattttgtctgtaatcagggcaataaactccgaattggtaggcttgcccttaccatagtttacagtgtatccaaacatggagtctatcgtatccatcctgcctctgctccatgccacctcgatagcatgccttatggctctctccaccctgcttgaggtagtcttgtacttctttgcaatagtgggatacaaaagctttgtgatagagctaagcatttccatatcctcaacgcacatcactatcgcagtcctaagatactgatatccctttatatgagccggaacacctatctcatgaatgatatccgtcacctgtgtctcaagggattttttctccatatatgtatcatcaagtggctcagtgtcaccggatgctctctttacatacacaagtaccacatcagaaccggcattaccgtttatcatgttgtatgcttcatcactacttcttgctgttcctaaaaactccatgccctttaataaactctgcatgtttttcttttcgtctgctactgcgacatttaaagtgctcatcaaactctcctatgccgccaattactgtcatgtcaaaacaaattgtatgcttttatgataacacattttgtcgaattttgtcgagagcgtatttttttttaattttatgtaaccattcagcccacgcatattcgcaaaactgcacgatacccgtgctttctctattcttcaaactgagagttatacagctctgcgtaaaatccgttctttgcaagaagctcatcgtgtgtaccctgctcgataatgtctccgtccttcatgacaagaatcatatcggcattcttgatagtagacagcctgtgggcgatgacaaagcttgttctgcccttcatcagattgtcgagtgccttctggatacggatttctgtacgtgtatcgacagaggatgtggcctcatcaaggataaggattggattgtctgcaagaatggctcttgctattgtcaaaagctgcttttgtccctgtgacacattggatgcatcctcgttgagctccatatcgtagccacccggcaatgtctggataaagtgatgcgcatgtgctgcctttgctgccgcgatgacctcctcatctgtggcatccagacggccgtagcggatattttccataatggtgcccttaaagagccatgtgtcctgcaataccatgccgaatgcatctcgcagatcggctctgttgtaatccctgatatcatgtccgtctacaagaatggcacctgagcttacatcataaaatctcataagaagcttgaccatggtagtctttcccgctcctgtcggtccaacgatagcaacctgctgtcccggctttacctttgcagaaaaatcattgatgatgatctggtcaggattataaccaaagtgtacatgcgaaaactctacacttccctcgatatggtctggctttacaggattttccactgttatatcctcttcctcctcatcgaggaactcaaatacacgctcagatgcagccgccatcgactgaagctggtttgccacctgtgctatctgctggataggctgtgtgaaattcttcacatactgtataaatgcctggatatcaccgattgtgatgacattctttatggcaagtatacctcctgagatggcaactcccgcgtatcctaagtttcctacaaactgcatgataggcatcataagtcctgagagaaactgcgatttccaagcggatttgtagagcacattgttggcctccttaaaggtctttacagtctctgcctctttattatatgcctttatgacaaggtggcctccgtacacctcctcgacctgtccgtttatgtgtcccagatactcctgctgctgtctgaagtatttctgtgaatgctttatgacaaacgaaataagtatcatcgaaacaggcaggataacgagtgaaatcagcgtcatgagcggtgaaatagacagcatcatgaccagtgtacctaccaaagtggcaacagatgtaataatctgtgtaatactctggttcaagctctgtccaagtgtgtccacatcgtttgtgatacgcgaaagtacctcaccgtatgtccttgactcgaaatacttcatcggcatacggttgattttgctcgtgatgtccttacgcatcctgtagcaggtcttctgcgtgatgcctgtcatgataagtccctgggcgaacataaagatggcactcaccacatataaagccagcgtaaacaaaagaacctttgcaatataatcaaaatctatgccgcctgttcctgcaatcttgttcatgagtccctcggcaagcgcagtggtggctttacccatgatcttcggtcctgcaacggagaagacagtcgaaactgctgcaaatatcataactgcaatgatggcagcccagtatctgccgagatactttatgagcttctttgtagaacccttgaaatccttggccttttctgtgaccattccggggccatgtcccattggccctcttggcctcttaggaggcatcttaaactgttcgttattattctcactcatcttacatgccctcctttttgttatcatcaattccaagttccctggctgaaagctgtgactgtgcaatctgcatatatacatcgcaattcttaagaagctcctcgtgggtgccttttcctacgattttaccgtcatcgagcacgagaatctggtcagcatgaataatcgtgctgatacgctgtgccacgataataacggaagcactctctgtaacctctgctaaggctgcacgcagacgcgcgtcagtcttcatatcgagtgctgaaaagctgtcatcaaacacataaatatgagggtcctttgcgatagctcttgctatggcaagcctctgcttctgaccacctgacacgtttgagccgccctgtgcgattgagctttcatacctgtcattctttgtctcgataaactcagaagcctgtgcgatatccgcagccttttttatctgctcatcactcgcgtctgctttaccaaagcgcaggtttgaggcgatggttcccgaaaaaagaatacccttctgcggaacaaagcctattgactcgcgaagctcgcttagtgtgtagtctctgatatcgtgtccatcaagctctattgagcctccagtcacgtcatagaaacgcggaatcaggtttacaagtgtagactttccacagccggtacttccgatgatagctgtggttttgctcggctccgccacaaaatcaatgtctgaaagcacatcctcctttgctcccggatatctgaaatccacatggttgaaacggataacacctctgtgatcagcctcagtaacaggctcttttggatcatttacagtgctgtttgtctttataacctcatcgatacgctctgccgcaacaccagctctcggaagcatgatggacatggctgaaagcatgaggaatgacataacaatcatcatggcatatgtaataaacgcagtcatggtacctacctgcatagagccattgtctattctgcctgctgcaacccacacgataccaagtgtgatgcagtacatgatcatggacatccccggcatcataaaggtcatgacacggtttgtaaacagctgtgtgcgtgtaagctcacggttagcctcatcaaacctcttttcctcctccttctcacggccgaaagccctgataacggaaagacctgtaagaatctcacgagaaacaaggtttaccttgtctacaagactctgcataatcttgaactttggcatcgcaatgccaaccagtgtgaaaataaaaaccatgatggcagcaaccgcaatggcaatcacccactccatgccggatttggtctgtgccaccttgatgataccaccgataccaacgattggcgcgtaaagcaccatacgaagcatcatagtagtaaccatctgaatctgctgtatatcgttcgtgcttctcgtaatcagtgatgccgtagagaatttgttaatctcggcatttgaaaaacctacaacctttgaaaaggtcttctccctcaaatccctgccgacagcggcaccgacctttgaagccgcaaaacctacaacacatgctgctataagcataatagctgcaaaggctgccatcttggcgcctgccttccacagataagcaacctgattggcatccacgtcgattcctgcattctcatcacactttgtcgcaaaagttacacccatggactttaaagtagctgaacccaccgcatcgattttttcctgcaccttgcttcttatctgctttatcatgttatcatcgagcgctactccctgcgggatagccgatgcatccacatccatctgctcacccgactgaaaagcctgatatgccatgacaagaggaaccaaaagctcctcatccagcttatcaagtgtgtccgaatcagctgtcagcttgtattttgccacaccgtcatcagattttgaagcatcctctgcctcataacagtccgtaaatttttctttctcgtcagacagcataaatgtctgtgccatctgataatcctccgatgtaatctcctttggcaggacatgctcaatgccatgatcctggatacccacatcaatgatgtcagatgtgtacgcaggcaaagccagatcacaataagcctgagcaatgagaaaaacaaaaattaatatgatccatcgccagtatggaatcagattcttgaaaattttactcataaatttttcctttctttccggttaatttatcccccatccacgaatgcaaaaaatatccgcaatcgtgcgcatactatttattttatcaataagcgcggataattcaataaagaaagtataaagaaacagtaaaaaaacagagactatataaattgtttatataagtctctgtttgataaattgtgcttaatcgaaaagtatgtgatagctaggagcctttgaaaactaatccaaatctgcaagacctacacgctgtatctggaaggtcttgtatgcctttgctgttgtagtttctttatcaccaccgctcacctgtgactggtaaatcttactatatcctacggcataaatctttatagaattagctccctccggtaaaacactcaatggtacctttaccttatatgtcttgttattttcaaagaagtcccttggatccttatttaattgactgttttctttactgttatttatctgttcattttctgttccatcattattcagtgtatagatatcccagtccaccttctttaagtaaatcttatcatttccggtgccaatcgtttcatcatttggatttttttgcggatcctcgatataaaaatccaaataaacaacagttttttcatcaatctgatttcgcacaaggtttgaatcctttaccgtaaaataaacatcctgcgtactgtctgcaccatctagtctggcatccgctttattagctgcttcttcttcaatggcatcatcaatagttgcatataatgtagttatgtcatttgaatcagtatctgcattctccttaagataaattgacggctcatgaactgatgcactatatgcagcaatcatagtgtttatataaagtttcaattcatcctcattatttgagaaatcggaatgtcctacacctgagtatgttacatttcccattgtgtaaatataataattatttcttacatcctttggagactggtcataaactccatggcctgacaaggtataccatacaacaatatcactctcaccatcaccatcagcatcctgattcatatccagctggtagtactgcttatgagtggtagctatatttatttcgtcatcaatcttaaaaggatatgtggtaatctgtcctgaattaaccttgactgccttattagtcttagcttcaacatcttcattactttcataattattaagccctgaatacagcctgtactcgccatgattgttaccatcatctttccactgaaaattatttaaatccacataagtaaatccctgattctgtctgacaataactgaattatcggattttggctcatatgcaatatcagtgttattcttttcagcggtctctacagcttttgtaaaatccgaatcagtactctttaatgtattgcccttctttaaatactcatttgacaggattccatacctgtccagtccgacagtatcacgaattatagagttaaacttatatccccagacattattatatgtagtatcatttttattattacaatatgatgttgtatcatgagcaaacagtactggttttcctgactggatataggcttttattttatcgagatgtttatttgtattatcaatatcataacaatcaccaaatccaataacaagcatatcgtatgtctgcagcttattacatacctcatccattttatttacgtcatcataataaactgtttctatatccaggtcaaaatccttcactttattaagtaattcatgaaactttgtattgccattcttctgtgtctgcatatcaaaatttcccttaaagtcctgattatgcttcaagtgtgaattaatctgaagaatcttgacttttgtaggactgcctttggaatttttgacatacacatatccggatttctgatcatatctgtagctatttgtagcctgactcacacgaagctgccaaggcataactcctacaaatccattcggcaaatcataaaccagtttataattataattgcctgcattcagactatacatatatttaccatcatcacccattaccggattcacaatagtaccatcacaatataattttattttatttgcagctattccttcattggttgtcgaaaacttaccatcagaatttgaatccaagaacagctgtgcattaaaacttgctttggaatcagcaccgcctgcattgtttattgaaaattccaatgtgatctgattattactaatctcaacataatctgtatcttttactttttcctgctccttgagtactatttcaggtttttcagtagtcaggtaggtaacaagctccgctggctcatttgacttattttttaagtttccattgttgtccacttcaagaacattgtctttaccttttgcatattttaaaaaattaaaaatatttgaacagttatcaatgtaatcctcattaattccactttcatacttgctatccttgctgaaaaagccatctgaaaagacgacaggaaagcccgcctttatataatcctccaattctgaaaccttctgcttagtaatatcattgcctgagcctctgtatgtgtttggagcagttaaataatcagcattatttccatttcctcttgatgtaatctgagtattaagcgcctctccattatttatataatcagtatccagcaatcccgcatgaccattcctgagcatatcataattccaatagtttaccctataatttggatctataacaacaatgtcaccaacatttgaatatttaagcccatccatgttccaatcattatatactgtatgaccatctctataattcagattatcggctacgagtcccatatatatcatgtcatagttattaaggtcctctattcttccaataaattctgcactcgtaacccttgttatcgtaaccttttttttctccgggcatcttgatctaagccaattttttagcttatcataatttaaagcgtcagactcattttttacagttccgggctctatatccagtatgttcagactatctgtcggatttataatgtctctcttatcagcatacgatatgatatagcttaaaactatcgcctttgaaatcttcttgtcataatacgcatactcgtcctttccaagagtatcattttcttttttcctgcttgtattctctgagttgatgtactctgctatctcgtcaaaattctcatttttagctgcttcgacaaatttagtttcatctttatcttcaataaacgcagaagcaaaatcatctcttaaaacaaatggtacatccttatcaggattatagtttcgtggaatgacatattcgttgccaattacatagccatgtgtatgagttgaactgtcaacttggtaatacgttatgacattgttatctttccagctaataaaattatcagctgagtccttggtaaaattcaaggagctgaaattgttacagctcaaaaggcctgcaagctttttaatgttgctatcatatttaatgttgctatcatcctttgtacttggacacacaataccattatccactataacaggcatcatgataccactctggtgcacgcgctggactatctgctttaccttgtcccatgaaatgtcattatcagtattatatgttgcagcatcgtttcctaaatcatttgaaaggacggactttgagcctgaaagatagagtaaatcaattgttgacacatctatctgctcaagctcctctggtgtgactgtttttaccttaaaggtcatattggcagtcttatcatcatcaccagtcttgccctcctgattgaacacacctgttctgaaccagttattgttcttgaaaccacccttataatatatgtgtggagtatttacaggataatcaagcgagccgtttttatcagcctccattatatagtcaccttttcccttacccatataggtgtatgtctggctgtccttaactatatcaaaatatccgtctgtatcagtgaggattacctttcctgtgttacctgccggctgattgtccggtgtgccatcatctatcttctcgtatggattctgtgagtcaagcactgctccatactcgccggtctcatcgtaattaaactcaataggtaccttagtatccacctcgtagtaggtctcgtcatcagtgattttacctgcaggcacatactccatctcaaccgtgcagtatgtatacttctcataatccggcttactgccatcaggcagacttgccatccggtcagctcttgcaacaaattcatatggtgatgtgatatctgaattgtcttttctgtaaatatatgcctttgggtcatattttgctatgttttgcatgccctcagcagaaccaatggcatatgcgctctttatagaataaaccacatgcttgtctgatgtgtcatctgctgtgcctgtatctgtcgtattgtctgtgctgctatcgatattaccatctgtaccgctgtctgtatttccatcagctttctgtgaattatcagtctctaccagatacttggtatttgtcatgccatccggcaattcgactgcagtaaatgcaacactgtagtagcctctttttccgggtgccttaatttgattgccattttcagtctctgtattagagccatctgcggtacttcctgtactgcctgtattaccggtactacctgtatccacagattcagagccatcttctgtctcatcctcgccctgcatgaaaacataatggtcaacattctgtctgtaatgacctgtaggcagtccatcttcatttacagcaagctggtaatcagtgttgaacttgtagtcacccttctcctgctttgtcatcttgtagccttcggtgccctgatttattttatccatatccacaagggcaagctcactccagtcattgccctgattgacataactttcctcatacggctcatagtaaaggggctttgtgttgtccttttcctctgtagtaataggcgcaagcttttctttcaggcttttcatataagcagccctattcgttgcaccttttccctctgtgtcagacatctttgacagtgtaccaaaccaattgtcaggctcctgaccatcaatcagatagccaatggatgccattttcttgtcaggcaccacctccactatattgaagggcttgtccttgccatgtgagctgactatatcagatattccattgaacgctacatttgcatcgacctttgttaggctgtcattcagcacaaaagctgccacaacgagacatcctgtaagtgtgagcgatattggaaccactattttttttcttaatttgctcattgcgattgctcctttgtaaaaaactactttgtttaataatatgtgtaaaacgtaattgtatttgacttaaatcccgactcttcctcaagtccaagccagacgctgatatttaatttttctccgacaaaaaaattttttccgagagtgatatgcattttttcattttgattaccatctacaatatgataattaagatagttcctatatttaggatcatcttcatgaccttctgctccggtttctccggcaatctcctttgaactaaacttaaatattccatcaggctcaccattgccatcaggaccataaatcagcttaccatcatcgcccattttaaaggatatatctcccttgtactcggttgcacccgttgagctgacactttctacctccatatgccatacaaaatccttaatctgatatttgccatttaatgaagatttttttaactccccttcatcaataaacaattgatgcgtctgtcctaaatcgaaatgcttatctgcatcacaatgcagaatattgattggatgtgctatgtttacagttacctttgccgtcaatgacggatcgtctatggatgttacggtgatgactaattgatctgtagtttcatcgctcatcagttgtacatcatatacatcaccattagcattaaagtttccaccatttttgtttcctgaatgatcccatgttacgttttttgaatcatactttccaccaagtatcttatcagtaaactttaaattattattcgttttcttcatctcatagtatactgttccgttggttacatccttgcctttgtaatatatccttattcctttaggttctgccggtgccacatactccacatctgccccagtcggcaccttattgcgcatagtgaagttctgttttgatgtatacttcttgtcccctgccttaaagtccacgacaattccgacagaattcttgctttctgcctcgcttaaatcaggtgtaaagcctgtgacattttctgccataagagattccttgccctgaccatccgccttcaccgcaccagttgcaggatccagtgtatcctttcgcagatagattttgtgctctgatggtctgtatatgatatagtatgtacaatccttgttgtaaataatcagcttgctgtcggatgatgtttcttcggatgacgcttcttccgctgatgcagttgcaatataaccggcctcaggggctgccgatgccacctccaccggcgctgccactgtagcaggctcatacttaacgcccttttgcgcatcaattatcaggtctcctatctgattcatggtaagctgtgcctcatactgtaaatctacgtcctttgaagcgtacttatactgcttcgtgctcgtaccgataaagcctgcaacagccaggcccagtattcccattatcgccatgacaatgacaagctcaacaagtgtaaagccactgtttttcctattatttgatttgttcatgcgccttaaaagtttcatggttcatcttcctctccgatttcatcatacaaccttataacagccttgcgtcaaaataaaatattcatcattaaactatgtaaattactcacataccaccttgccggtctccttgtatatcgtgataaccttttcggtgctgtttttttgaatccagatacggctgcagcacttaccattggcatcaggcttttgtgcacctgagcttctgtcaaactgaagcactatactgcctgaactgttcaattgtgtcttatcactataatcatccttcatggaataatatacatcaatcctgctctttcctattttgctaggagcagatactgtaccatttatggtcgtcttataatagtaggcaccatctgatgcatccttatatatctcaagaactgcgctgtcctttcccatagtggtgacccttgttttattaattatcgattcaatatttctggcacactgcttcacctcaacacccatgaccgagcgaatggatatggttgccgcacctataagtacgacagatatcgctatcactactataagctctaccagagagaaaccgccattattctttttttctgttacagacatattggattcctcccttgtatatatcgtcaaaatttgccaaatataaatatttcgcagctgttttgcgccttaaaagccgcttgttttctactccttggtccagttctggtatgtaatgagcgtagcataatctatttttgtgtccgcctctttcttatttgaaaaagaagaaacattacccagatagttggcaccgtccatgaacacatcatacaggtgcagtgcatcgtctgcatcacttaccttttcaagaagcaatgccttaaatacctcctgagtaccattatcaatctcgcactggtctttgtttacaattatcctgccctttgcaactatggtacctgtaaagtcagcattcagtgtcacatctcccgtagcaacaattatatccacattgtgtgatttgtcatttgcatcataggtgtagttaccgtttttgacaattgcctggtatttttttccctgatactcagtctcaaatatatgtttattaccggaatttggcactattttcagcaaattggtattgttaactatatttgtaaaaagcgaaacacttgctgcatttgtcggtaaatctgcataatttgtcaaaagctttgagtttagtgcagtatacgtgtgctgtaaggcatctgactgtgcatccatgtccacaccatcagctatgcccttcaaaaggcttaaattgctgccatcgtagatgctgtaattgccggcagtatagatgcttgctgcctcatttacctttatgctgtcagtatagaacttagtgtatctattgagcttgtcactgtctgcgccaaaatagtctctgtaatactcagctgccttgttcgttggcagatttacataatagtatacaagtccatcatcactattatcagtagaaggaacaaagaccttctttatacagttgtcgattgtctttttctccggcagatatgccgagagagacttacctgtctttgtgctgaccacattagcattaacttcagtatactttgtctgatcctgtccggttgccgtgatatccttgtactccttataggaaagtggattcttgttgtaaagcgatttggcatccgcaccatctccacttgtgcctatgcactcaggcggcacaaggtatgctatctggtcaccctttacagagattgactcacccatgcccacattgctgttttgtgtacccacactacttgagtttacaatagcctgggtattgatatatgcggttcctgctaacataagctccctgatatttgacatatcaagagatgcctccctgccgtttatgataatagcagagctatcgcctgcgacaggattttccttgtcagcacctccgttgccaaagccgacgtacttcgcattgttattcttattattcttgccaagtgtaacctttgagcctgtaccctttaaggtcatgtcatctgccacatatgtcatgccatctaaattgactgttgcaccatttacatttatgttgcttgtccacagctggcactgtgaatcaacagaaagtgtactgttattgtgtacccccgccatattcttttttattgtaccagtatcttttccggcaaagtctcccacctctatatcgccctctgcaatcatatagctggtatcctttacatcaagtgtggcattgtttggaatggtaacactcgtagtagaagtccctgtgcctgccgcattttcacagccggcgtagagattaccggatagattcactttattaagtcctgatataatatccagtccttcatttccgacaagagaatatgtaaaaagctccggaactcctcccgatgctgtaaagctcatggatggaactcccagagaaatatctgtttctattattgatttaaatcccttttcatcggtatactctaccctgatgccattaatgactgcgcggctgttgtataccttgagcagtccatttccattttcatcggcatttaccgccttgaccacagcgtgtggctttgagttttcgtctgtgagcttactatccacatagtctttaagcttttcagttttatagtgcataccggtattgtcagactcaagacttccctttaagctctttaaatactcctgcgcaaatatactctgtctgccggcctcatttatgctgctgtcagagtaattctccataacctttgtatatcctgctgagtaagccttggaaatatctccctgcagaccggtacatatctgatccagcacaccctctgccgagtaaaagttgtctgtatttttttcgtccgtcaccttcatctggaggttcataagcgctatccacagcacagtcacagctaaaacagccactatagccattgcaactacaaccatcacaaaggaagcaccacggttatcattacgcttcataattaataccccatgcttccggtcatcgtaacaaccgggtctttatccttaaatatatcatccagtgaagccttgctctcgtatacagccaccttcacatcatacagcctttcagatgcattgctttttgtcagattctttatatcgacaattgcctttacatcattctgaattacattgttattaaagccatatatagcttgatcgggctgtagtggattatccggtgctcccatatttacattcagattggtggctatatgagtataagcatgacctgtacgatttcccggctcacttaccttcacatatgccttatatgtactctccttcgtgctcaactctgactgatccgatatagtcttttgctttacaatgtttaccgtgcagtccagcttgtccttattattgattataatgacatcgttgcaggtattgtaaagtgttcctgtagatgtgtaccatggattgtaaaacagatagacattccttagattatggttcacagtatctgaagaattatcataaatcaccatggtataatcatccttcagtgcactattcggatccggaaaagtctttcttactccattcttattgatagaatatgaatacgacaccgtaaccttggtagccttattactcgaagctccatacttttctatatctatggtgatagttcttttgatatcctgctgagtgatgccgcctacaccaggcatattattaaatgcatacataatatttgtagcagaatacttgtctgcactcatgcagtcaaaatttgcatccatggccgacatatccgctacctcgtccatgttgtactttttaaccttattgtccgactctgcgtccgattttgcatccactgtcacaagagcattgtatttctttgtgcctgactgcacgcctgacatatagaaataatacttgtgcgcatccgactccctgaaattccaaagcgatgtatcgcttattttggcagatgcatcagtcttgtggatacagctagtaatgacatcgtccttgtttacaatctcagcactgatatcctcaagcctctttacattatcaaacttgcccgacttcttaagaagctcacatgcactgcttccatctgatatattaaaaccgtccgccacatcaaagccctccgacggatagttaaactgatatgccagtgtcttcatggagttcttctcaataccctccataatgtttgtcgccagatgtgtagcattcagctcgttttttgcctttacattggtctttgtagctgtgacaaatgcgttcaaaaaaggaagcacgattattgcgagaatagcaatcgacacaataatctccacaagtgttactcctcgatcatcgttttttagctttctcaaatctgcttcctcccctcttgtattttattatctcatagctcaataatctaacatttgatatttatcacttacggtctcaataacccgctaatctaataatctaatattataataatcagttagtttgtcgtaccaaacagattatttgtaccatgtggtactgcaggtatgtatggtgcctcatatggcttatcaagtccatacaggaaatatgaatccacaagcatctcacctgtcagcttgcctgtcgaatcatcaaagctcacattgagcgtgctgatagttttcttctgtgatgaaccaatcacctctccaagcatagccttaagcccatgatactctgtcttgaatgccataactgtgctgacatcataaagctgatagcctgtaaccgtagactttgcagagcctgttgatgtactgccatcagctgcactgccgtcgcctgtctgtgactgagagctgttgccatcagcggtctgagagctctgcgaactgtctgcattactgctatccgtggtactgctgtctgaactgcttcctgacgaagaatctgtacctgcatcgccggtcggattattcacatcaatagctgtcggtgagccgactgtaagctctgtaatatttgtattggtagatttctcgatagcaaccgcatccataatgccgttttcaatctgtaaatatgaaggaaaattgtcatatacctgctgcatggcatcagacatatcctttgtcttctctgtgtagtcatccgcctttgccgcaagggctgaaagctgattgtactgtgatttcagattcatattttcgctcttgagtgaatccctcttattggactgcggcataaaaatcaaaaaatatgtcagtgctaaaatggcaacacccgctaatataataagtaactttttatctctcgttgacatcctaacaccccctactgatttgtactgtctgtatctgatgaaccactatccgtctgtgtctgtgcctgcgacgacgcatcctctgaggtatcagctgactcactgcccgtgccatccgccgattcagaagcagcactgtcgtctgcctttacatatgtacaatctactgtgaactgaacctttgaagcaccggtctcatcaacctcctctgtgatggttgacacattggataccatgatactctcaaatgtacgaagctgtgcaattacatcagccgctatatccttgctgcctgtctttatggtcatcgaaacgccatcagtcgtaacagacatgttcacaagcttggcctctgacggaagcttctgctccagctcatccacgaagccagttatctcatcattcttgttggatgaggcgctctcaagaagcttggtccagtcatagtccttcttggtctggttgtacacatcatatatattctgtgcatatgacaaatcagaaacacgagctttaagcgtcatattgtctgaagttaaaacaagatttgaaaaaatactgtatgccgtgataccaactgcaactaccacacacaatccaaaaatgagaagctgcaccgcaaaagaaacaggcttttcagctgtctcccctgccggtacgggaagaggcttcccatcaggaccgacaggtggatttccctgcgtaccagcctgtgcaccgccggatggcatagcacctgcagctgttcctgccataatcggagcaccgattcccttgtttttcttactgtcaagtatatcaagcgggctcagtgaacatccgacacagttgaaatactctgcaagctttgcctctgcgaggtttatgctctttgccacatgtatgccgtcaaactgctgaagcggaaccaccttgacattcagctcattggtcaaaagctttgagagtccgctgaaatcagcacctaagcctatgaggaaaattctatcgataggagtatctgagtttctcgactgataatagtctattactcgtccaagactgcttatcagattggaaagtgcatatgaaacattcagacgaagcttcttaaaacgctccgaatcaatctcatgccccataggatccattacactgcctgcaggctcatccggcactgtaccatcaggctttattgcaaggcatgtctttctgcgtgccacatcaactgcatcggtaaatgacagatactctccaaaaagctcactatcctgaatctcctcaatagcatcagcaagtccatagttgacattgcgctgcagctttaccatgcttccatccattacagtcagtgtggtagaaacctcatccaccttgacagtcaccttcacatctccgggaatctctcttctcatgagctgcttgatggcatttccactatagtcaagtgctacaagctgcagcctgcaatcagctgcaagagcaccatacgacaaaataagatcattaggtacagcaataaccgaaagacgtaattttttttcttccggtctgtcaatcttctctataatctgatgtaccagcttgtactggctcaaatccaccggaaaataatccgatgcattcattgcaatcatttccttaagctgtttttccttaacaagcggaagctcaatatctctgcttgctatacgcgctgaatttaaaacaaaaacagcttttttggtggaaatcttcttttccttcagcttactgtataagatagaacgaaacatcccatccggctgtaccactccatcattaatcatccccggtggtgtcggaaagccgaacatattgtaaatcttagaattttttgctttgtaatcaatctcaactactctggtaaggttctcccctatttcaataccgagcaccctatttgccataacctagtcctccgtgtttatctttgttttacactgtatacatctgtaaaacattcgtaactgttcagttacaaacattctatatatatatatttcggtatatctgtgtcttctctgcttttgtctcactgcttgtcgtactacctgttttatattaggtacgctatattataacacgtttttcaaaagcctgcgagtgtcaaatatgccgatatcattttctcaccccatagcatcgaaataaatattccggctgccaagtacggtcccatcgcaagcctgttgcctgcgtttgttactttcatacgaatcagatgtatcacggaaccgatgatgcatcctaagaaaaatgctaatgtaatattctgccagcctatcgcaaggcctgcacatgccatgagcttgacgtctccgccacctatggctcttcctccacttacaagaagaaggatttcaaggaataaactgacacaaaagaatcctatcacatattcagaccagttatcatggtctaaaaacacatgcaggattccaagcaccagtataaatatattgattcctaatggaatttcatatgttctccagtctatcacactcagaactatgagtgcagatgtaagaaagcagtagatgatactcgtaagctcaagtccatttactgcaaaaactactatgtataatataccgtttaacgcctcaataatagggtattgaggtgatatcggttctttgcacttgcggcatctgccacgaagaaacagccagctgaaaaccggcaccatatcgtaccacgcaagctgatacccgcatctcatgcagtgggatctttcggtcaccactgtctcatgctgcggtatgcggtagatacagacatttaggaagctgcctataactataccgaatgcaaatattaagatgtagatgggtatcagttctgtggtcatggttggtggtccttttagtaattattcagctatatctttttatttacttattgaaaatacttcattcatatccttcttaggattttttgtatttgtagttgcagtagcagttgttgaccacgcgcctgttcccggatctaatgtatatgttattgttggccatccactagactttaatgcagcacttgaagtagatggtgtgaccgtacctgagcttgcagtaattgtagtagttgcttttttgccactaattgcaatagttacagaagtaacattctcattatctgaaatatcagtttctaccgaagacttaagttgctgtacactctgcatatctgttgactgtctagacttctcaacatacttgataaactgtggagcaagtacacctacaagcactgccatgatggcgattacaacaataagctctacgagagagaaacctttgttgttcttctgtttctttcctaactttttaaatacattctttaccatagttcttttctccttttcattataacatggtttttgtgcaaagagctgtgccctatcagcatctctttggtttgtatgcgctcattgtaccataaatcaaagcatattgcaagttattttctagtacaatagtatcattgctgtataatttttttcgccttttttagcaattttaaccaaatttcatccgttttattgcatttatatcatatttttcaataaaaattttttccagagctatactccgccacagcataaggggcttcatcccatgtgaccggctaacgcatacactctcgtgagagctacgctacactgccaagatactgtaggaattatgcttttagattttctatgcttgacgaaaccgtcgaaccgcgccgtccgtggcgcggttctccttgcccattactgctcacaacatcagtgtgaccagtaacgattacagcccattaaaagtgcctctacgaggcagggggctgtaatctgacaatagttgatttattggcgcatagcttgacagcgtggtgtcaagcttgcgtttgaacagcaacgatatattacatcccagtggcagttcatttctgtgtttcatgcgcataattcaacagtatctaagcagcttcgctattcgctcacccgagagtatattcgccagccgttcgtagagaatgaagccccatcctactgtcagcaaaagaggaagcaacctccgggctctcgcccaaagattgcttcctctaatttacatttcactacaatattagctcacaagccatttttttacagtttcctcatcaaaatccacacattcagctatatcttctattgagtgtccttttttctgaagttttaaagccgttacttttgcctgacgaattctgccttcttctctgcctaattctctgccttcatttttctgttcttcccatgccttacacatatcaatcacctcttctttctcatctatgtctatatccgttcctgcaaacaggttgattgcctcaaccgtctctctgtctacattgctaaacttttcatcattctgcagcacttcctgcatcttttccttatcatacgcattctgcagtacctcgaaaagctgcctgatggatgtcctgaatcctgtaaagtctgttatctccctcggtgccagcagattaattctgtaatccggtatgaatggcagaagttcttcatccacatcaccaaacatatccgacagcttccttggaccatcccattcctttgttccgagatacactgtaatcgtaattacaggaatcagcttatcctctttcgtaaatcccgatagaaattcatctgatgttgctgtatccttttcctttcggtgcttttttgctgtttcctttacctgattgccatatgccatgacatcataaaacatgttttttaccggaatggaatagtgtatatccgactgattttctactcctatcagtaccacatatgatttgccggtatatttgatactggcatttttgaagatgtccctcagcttctgcaccgctattgtctttttgtcaagtcctagtgcggttagtaccttcgttgtgtctctttccttaaggttttccggcagtatgacctctcttcctccatacagtatattgttgcacagatccgcaaacctggcattgtctgcaaagtattcctttgccattgagtcctttgcgctcaatccttctcctcctgttctcttgtgtgagcaggaaaatttggtgccaatgagggtacagtggtacaatttacaaagtacacatatactgtccttatttaatgtttactcactgtatacagttcatccgccttttgactacattttctgcattctgtctacatacggcatttaaattttcctgctgttgattggtaattaaagcatcgaaaacttccatgtcctttgtagaataatgcgaagtggtctgccctcttcaaagtggtgcgcacctgaaaaactgttatgtggtgccgcttacagaaatataatgctttgagttgattgtagcatagaggtggtgttttgtcatcacattttttcttttttgccacagcgtaaggggctttatcccatgtgaccggctgggcacactctcccgcgtgagcgaatagcgaagctgcctagatactgttgaattatgcacacgatacacagaaatgccctgccacggatggcagggcaaggagaaccgcgccacggacggcgcgtttcgacggtttcgtcgggcatcgtaaatctttaaggcataattcctacagtatcttggctgcgtagcgtagctcacgtgagagagtgtgcacaagccatggctcatgggatgaagccccgtcctactgccagtacctacagttgctatgccagcttcttatttttctcaagaagctcatagattttctcaacatcataatccggcttcattgacaatgccgcttcgtaaattggagcgataacctcctctttttcttccaggtcatctgctatctctgccacactcttgtccttttgcagcttttttacaatctgagaaattatcttttgtctttctcctaattctcgaccttcttctctgccctcttctctgcctaattctctgccctcatttttctgatcttcccatgccttacacatatcaatcacctcttctttcccatctatgtctatatccgttcctgcaaacaggttgattgcctcaaccgtctctctgtccaccttgctaaacttttcatcattctgcagcacttcctgcatcttttctttatcatatgcattcttcagtacctcgaaaagctgcctgattgatgttctgaatcctgtaaagtcggttatctccctcggtgccaagatatactgtaattgtaattactggaatcagcttatcctctttcataaattgtctctttaaactgatcgtagcagagctatgatgctttgtcattatatttttttccacagcgtaaggggcttcatcccctgagaccggctacgacacgctctctcgcatgagcgcatagcgaagctgcttagatactgtcgaattatgcacacgatacacagaaatgaactgccacggatggcagttcaaggagaaccgcgccacggacggcgcgtttcgacggtttcgtcaagcatagtaaacctataaagcataattcctacagtatcttggcagtgcagcgtagctcaagcgagagagtgtgcacctgcctgtctcgtgggacgaagccccgccctactgccagtacctacagttgctatgccaacttcttatttttctcgagaagctcatagattttctcaacgtcataatccggcttcattgacaatgccgcttcgtaaattggagcgataacctcctctttttcttccaggtcatctgctatctctgccacactcttgtccttttgcagcttttttacaatcagagaaattatcttttgtctttctcctaattctcgaccttcttctctgccttcatttttctgttcttcccatgccttacacatatcaatcacctcttctttctcatctatgtctatatccgttcctgcaaacaggttgattgcctcaactgtctctctgtctacattgctaaactttttatcgttctgcagcacttcctgcattttttccttatcatacgcattctgcagtacctcgaaaagctgcctgatgaatgtcctgaatccggtaaagtctgttatctccctcggtgcaagcagattaatcctgtaatccggtatgaatggcagaagttcttcatccacatcaccaaacatatccgacagcttccttggaccatcccattcctttgttccgagatatactgtaatcgtaatcaccggtatcagcttatcctctttcgtaaatcccgagagaaattcatctgatgttgctgtatccttttcctttcggtgctttttggctgtttcctttacctgattgccatatgccatgacatcataaaacatgttttttaccggaatggaatagtgtatatccgactgattttctactcctatcagtaccacatatgatttgccggtatatttgatgctggcatttttgaagatgtccctcagcttctgcaccgctatggtctttttatcaagccctaatgctgtcagcacctctgtggtattcctttccttaagattttccggcaggatgacctctcttcctccatacagtacattgttgcacaggtctgcaaacctggcattgtctgcaaagtattcctttgccattgagtcctttgcgctcaatccttctcctcctgttctcttgtgtgagcaggaaaatccggtgccaatgagggtacagtggtacagtttacaaggtatacatatgctgtccttctttatgttttctatatgtttacattatgattatcacactgtatacagttcatctgccttctgactgcattctctgcattctgtctacatacggcatttcaattttcctgctgttgattggtaattaaagcatcgaaaacttccatgtcctttgtagaatgatgcgaagtggtctgccctcttcaaagtggtgtgcacctgtaaaaactgttatgtggtgccgcttacagaaatataatgctttgagttgattgtagcatagaggtggtgctttgtcatcaaattttttctttttttgccacagcgtaaggggctttatcccatgtgaccggctgggcacactctcccgcgtgagcgaatagcgaagctgcctagatactgttgaattatgcacacgatacacagaaatgccgcgccacggacggcgcgtttcgacggtttcgtcgggcatcgtaaatctttaaggcataattcctacagtatcttggctgcgtagcgtagctcacgtgagagagtgtgcacaagccatggctcatgggatgaagccccgtcctactgccaatgcctgcaattatctcaacaaaagaagaagcagcctccgggctctcgcccaaagattgcttcctctaatttacatttcactacaatattagctcacaagccatttttttacagtttcctcatcaaaatccacgcattcagctatatcttctattgagtgaccttttttctgaagttttaaagccgttacttttgcctgacgaattctgccttcttctcgaccttcttctctgcctaattctctgccttcttctctgcctaattctctgccttcatttttctgctcttcccacgccttacacatatcaatcacctcttctttctcatctatgtctatatccgttcctgcaaacaggttgattgcctcaaccgtctctctgtccaccttgctaaatttttcatcgttctgtagcacttcctgcatcttttccttatcatacgcattctgcagtacctcgaaaagctgcctgatggatgtcctgaatcctgtaaagtctgttatctccctcggtgccagcagattaattctgtaatccggtatgaatggcagaagctcttcatccacatcaccaaacatatccgacagcttccttggaccatcccattcctttgttccgagatatactgtaatcgtaatcaccggtatcagcttatcctctttcgtaaatcccgagagaaattcatctgatgttgctgtatccttttcttttcggtgcttttttgctgtttcctttacctgatttccatatgccatgacatcataaaacatgttttttaccggaatggcatagtgtatatcggactgattttctactcctatcagtaccacatatgatttgccggtatatttgatgctggcatttttaaagatatccctcagcttctgcatcgctatggtctttttgtcaagtcccagtgcggtcagaacctccgtggtgtccctttccttaaggttttccggcaggatgacctcttttcctccatacagtatattgttgcacagatcagcaaacctggcattgtcagcaaagtattcctttgccattgagtcttttgcgctcaatccttctcctcctgttctcttgtgtgagcaggaaaatttggtgccaatgagggtacagtggtacagtttacaaggtatacatgtgctgtccttctttatgttttctatatgtttacattatgattatcacactgtatacagttcatctgtcttctgactacattatcgggcttctaactgccctttggctgcactttctgtattctgtctacatacggcatttcaattttcctgctgttaatgggtaattaaagcattgaaaacttccatgtcctttgtagaatgatgcgaagtggtctgccctcttcaaagtggtgtgcacctgtaaaaaattgttatgtggtgccgcttacagaaatataatgctttgagttgattgtagcatagcggcagttctttgtcatcataatttttctttttccatatttatattttttcatactgtttctgcactgcacgcctatcagcctgcattctgccacagtgcaaggggctttatcacgtgagaccggctggggcatgctctctctcgtgagcgaatagcggagctgcctagatactgtcgaattatgcaaacgatacacagaaatgagctgccaccgggatgtaatatatatcattgctgttcaaacgcaagcttgacaccacgctgtcaagctatgcgccaataagtcaactattgtcagattacagcccctgcctcgtagaggcacttttaatgggctgtaatcgttactggtcacactatggtgtgaccagtaatgctcaaggagaaccgcgccacggacggcgcgtttcgatggtttcgtcgagtatcgtaaatctttaaggcataattcctacagtatcttggctgcgtagcgtagctcacgtgagagagtgtgcacaagccatggctcatgagatgaagccccgtcctactgccagtacctacagctgctatgccagcttcttatttttctcgagaagctcatagattttctcaacgtcataatccggcttcatagacaatgccgcttcgtaaattggagcgataacctcctctttttcttccaggtcatctgctatttctgccacactcttgtccttttgcagcttttttacaaccagtgagattatcttttgtctttctccgatttccttaccgatttccttaccctcttctgttgcaacctcttcccagtaatcactcacattacacatctcgctcatcctcccttcgagttccatgctcattttaagtccataatcttcttcaagtatcttctttttctcgataaactctgactttgagaacagctcttccagcattcctatgagtttattcttagactgctttttattttttgttgctctcgtccggacatttatcagtgcaccatttaatttgtcaatctgtggtattttctttattttaccataaatcaggctggatttcatcccaaattcgattctgccatcgcgtaaggggcttcatcccctgagaccagctggggcacgctctctcgcatgagcgaatagcgaagctgcttagatactgttgaattatgcacacgatacacagaaatgaactgccacggatggcagttcaaggagaaccgcgccatggacggcgcggttcgacggtttcgtcaatcatagataccctataaaacataattcctacagtatcttggcagtgtagcgtagctcacgcgagagaatgtgcaccagccagggctcatgggatgaagccccgtcctactgccaatgtctctgcaccaaaaaagcagcctttgagcttcacactcaaagtctgcttcttttttattttataaactgtccatagcctgatacatggtaagcataggagccataacggctgccacaagcacaccaacaataagtgccagaacaaggataatcataggctcaatagctgccataactgtctgggtagccaactcaacttcctcatcatagtagtctgccagtcgggtaagcatgccttccaagtcaccggtctcctcaccgattttggtcatgtgtgaaaccataggtggaaacaatccacacgcagtgattggctcagacagcggaacacccttacttacttcttccctcgcacttttcagtgcttttttgtaaagggcattcttcatggtgtcagcagtgatgccaagggcttcaatcatcggaagtccagagtacacaagtgtggaaagtgtacgcgcatagttactggccgctgtcttgatgtttagctttccgaaaaccggaagctttcttgcgagattaccaaagaacatctggccgctgtcagtctgcttataaagcttgatggctataacaattgctgctatgacagcaatcacaatataccagtatccggtgacaaaatcactcatcgcaacaactgcctttgtgatgcccggcagctctgttcccaggtcattgaacatctccgagtagcttgggatgacctttacaagcattacaataacaaccgcaatagccacaatcacaacgataatcggataaactgccgctttttttatcatgccgttaagctttgctgatttctcgaagtgtgcagacattctgtcaaaagctacatcaatcttgccggatgcttctcctgccgcaaccatgctcaccatgatgtcagggaaaacattcggatattttttcagaccatccgagagagtctcacctttttgaatctcggcatgaacacctctgatagctttcgccatgaccttgttctcagtctgatcggatagcatatccagcgtatcaagaatcgtaacacctgcattgaccatactggtgaactggcggcagaatactgataggtctctcggctttacctttcctcctacactgaacgagatttccttggtcagtgctgttgccttggtgaggcttatgaccatgttgccatccatcttaagcttattttttgcctctgcttctgactcggctactatatttccttttctttcttttccgctctggtctataatctgatatgtccagtcagccactttcttctcctccttatacctattctgtgcaacctccagataaattaaatcataatttattaagactccacaacattataccataatagtaaaatacatacgattatgccatcaatagtaaaggtgtacacggctagccatgcttaccggatcatgtgcatatgcaactgcagtctccggcgctataaggccctggctgtaatactgtaaaatacagtcatccatcatcatcataccctctctctttgatgtctgtatgatagatggaatctgaaatgcttttgcctcacgaattaagtttctgatggcattgtttgcaaggagcacctcaaatgctgcaattcgtccgccatttaccattggaagcagatgctgtgcaacaattccctctaaaactcctgagagctgcactcgtatctgttgctgctggtgtggtggaaaaacgtcaatcatacggtcaattgcatctgatgaactgttggtatgcagtgtagaaaatacaagatgtcctgtctccgccgctgtaatagctgtagatatagtttcaagatctcgcatctctcctacaagtattacatccggatcctgtcgcagtgcagctctcagggctgcagcatatgagagtgtatcctttccaacctctcgctgttccactatagagcggcgccttgagtgcaggtactcgataggatcttcaagcgtgattatatttttggaatctcttgatgcaatgacatctataagacttgccaatgtggtcgacttaccacttcctgtagctcctgtcacgaggacaagtcctctcatctttgtggtgagattgacaaccgactgtggtatgccaagctgctgcggtgtaggcacatcatatgagagaatacgaagtgctgctgcatatgaacctctctgtctgaacacattggctctgactcgtgaaaagccctccaccgaaaaagcaaaatcaagctctcccttctcctttagctcatctttaagctcctgcggaacaattggtgaaagcaggttgtccgtctcaacattggtaagaacctgatttccctgcggtacaagctttccgtcaattctaagcataaccggatttcccggtacgatatgtatatccgatgagttctgttgctgcgctgcttttaaaatgtctactatctgcattttcttttcccccttagttttcaaacgtggtctttaacatttcctggaatgaagtaactccttcgagtacaagcttctctgcactctgtctaagtgtatgcatgccctcatcacatgcagccttgtttatatcctctatatcaacaccttttgaaataagtgactttatctttggtgttatggtcattatctcatatataccgattcgtcccttgtagcctgtattggcacatttttcacagccacatggctcataaatctttaccggacggaatgccggtatattcataaaggccttttcctcctctgtcaacagatgctctctcttacatgccggacaaagtcttcttacaagtcgctgtgcaatgattccctttaccgaatccgcaagcagataactttcaactcccatgtcctccagtcgtgaaatagtacttgccgagctgttggtatgcagtgtgctgaccacaagatgtcctgtgattgacgcctgtactgcaatctgtgctgtctcctgatctcgaatctcaccaatcataatgatgtccggatcctgtcgcagaatggaacgaagtgctgatgcaaatgtcaggtcagctttattatttacctgtacctggtttattccatctatattggcctcgaccggatcctcaactgtgatgatatttacatcctccttgttgagctctgaaagtgccgtgtaaagcgtggttgacttaccacttcctgtaggtcctgtaacaaggatgataccgtttgtattcatcagtatatgatcaaaggccttaagctcttcgtctgaaaatcccagctcctttttatctcttgtaagtgcctttttctgcgcaagtcgcataacgcatttctcaccgaatactgtcggaaggattgatactcggatatcatactctatcttgtctatctccatagtgatacggccgtcctgcggcttacgtttctcggaaatatccataccacctataattttaagtcgtgtaataattgcagaaagcagatgtatactatatgctgccttctcataaagcgcaccatctattctgtatcgcaccctgactttattttccagtgcctctatatgtatatctgaggccctgagtctggctgcctgctcaatgatagagttgacaagtaaaactaccggcgaattgttgacatccttgctggtagcttcctcagcctcggcatttttctgctcacgctcttttctctccctcgcatactcctgagccgctttcatagcctctgtatcaccgtaatatttgtcaagcgtcaaaagtatgtctctgcctgtcgctactgcaggctcaacctgtagattggtaacaattgaaaaatcatcaagcgcaaccatatccataggatcagccatggccacatgcactacattggcattattcttgtcaaatgcatatggtatcataacatgctttctaagcactgtctcactgacaaggttttgcacctcctcaggtatgttgattgcgctcacattaacaagctccagtcccagctgctgtgacaatgcctttgctatctcaagctcattggtgaatccaagctcaatgagtgtttctcctatcttcttatgcttttctttggctataggcagagccttttccagctgctcctgagtaattacattttcatttataagcatatcaccgatacgctttttctctcgtctaaaagccatagtggctccccctctttcatcatttagtaaaatactaccattatgatggctgtatttcaagggtatttatataaaatatacaataattttatttcaaaactaaaaagtaacgattccgagtgcctgcagcaacagtataagcaggaatgccggtgcaataaatttaaccatgattatataaagcccttttctggtgaatttgctgcctccgcgtgtcacctcatctattattacctttggacttactatccagccaacgaggatacatgtggcaagtgcaacgattggcataagcacattgttgcttacataatccatgatatcaagtatctgtccgactgtgccgtttggaagcttaacctccatatagagcttattgtagccaaggcagactattatctctgcaatcagaccgtataccgtgactaaaattgcgctttttctgcggctccagtgaaatctgtctataagactcgatacaatagcctccataattgatacagacgatgtgactgctgcgaatgcaactatcatgaagaatatcagtccaacgatatctcctgctattcccatttcattaaatacctttggcagtgatataaacataagccccggtcctgctgacatgccgtcacgacccataaatacatatactgccggaatgatcataaggcctgcaaggaatgcaacaagtgtatcaaaaatctcgatctggttgattgagcccatgagctttgattccttcttgacatacgaaccatatgcaaccatgattcccatagccacactgattgagtagaacagctgaccgagcgcatcaacaaatactgtgacaagcttttgcattgtaagccccttgaagtcaggaaccacatatatcttaagcccctcaagaccacttcttgctgcgcctgatgcatccttataatggagcgtcagcgagaaaataccgattgcaaaaataagcacaacaaggataggcatgagcaccttgctgaagcgctcgatacctttattaactccgccaatgacaactgctgctgttataagcagataaaccactccaaatatgattggtgcccactggcctgtgataaagcctgtgaaatatccatccgcaaccgcattcttaccgcttcctgtaatgaaaagtgtaaagtattttaaaacccatccacctatagtacagtagtaaggcagaataatagccggtactatacacgcaagcacaccgataaacttgccctttggattgataagcccatacgctgtgagcggtccctgtcctgtcttacgtcctattgcaatctcagtggtaagcaatgcaaagccaaaggtcagaacaagtatcagatacaccaacagaaaaagtccacctccgtcctttgctgccagatacggaaacctccatatatttccaagtcctaccgcactgccggctgccgcaagaacgaacccaatgttgccggaaaaagtgcttcttgatttttctttcattttctactgtctccttaatatattatataatttaatttcgatttaatatggacattgtttccatttacaaatctaatatacctattataatcatctagagtactttttgcaacggttgatattttttattcgcatttgcagtgtggtggcacatagcaggtgtcaccaaacgtaacgcaaattcaccactacataaggaacgtaagccccgggtaccgcgggtgcacacgtactcccgccggagcgcatagcgaagtagcttagatactgtagaaattatgcccacaagacgcagaaacgcccctgcatggacgcaggggcgaggagaaccgcgccacggaaggcgcgtttcgacggtttcgtcaagcatagaaacccatcaagcataatttcgtacagtatcttagccacgcagcgtagcgacggcaggagtacgtgtgcgcccgtggtacccggggcttgcgttccgtactatttattgtcctaaataaggttcttgattccctctgttaaacgctttgcaactctcacattgttcatagtgtaaagatgaattccctccacatcattagctaaaagctcaattatctgactctcgcagtaagacattccggcatcaaaaagtgccgccttgttgtctccgtatctgtgcacaatcttctggaacttttccgggaactttgctccgcacattgtgaccattctctgaatctgagccgcattgatacaaggcatgatgcccgggataacaggcacattgatacctgcaagcctgcagtcctcagcaaaattgaagaaggtatcattgtcaaagaaaagctgtgataaaagaagctctgctcctgcatcaacctttttcttaagattcttaatatcatctaccttatcagctgcctccggatggatgtccgggtagcacgcacctgcgatacagaactgatcacctgtggtgtcctttatatacttaataaggtcgcttgcatggagaaaatcctcctttgcaggcacatttggatttctgtctcctcttaaagcgaggatattctcgatgccctcatatgaaagctgtctggtgaactcatctatctctgccttgttatagcacagacatgtaaggtgtacgaccggctccacattgtactggttcttgattttcttcgcaatctcgatagtcttgttattgtttgagctgccgcctgcgccaaatgtcacgctgatgtactcaggatgacaatcacagagtatctcaagcatctcgtctatatttttgaagtcttcctccttctttggtggaaatatctcaaaggagagcgactgtggtttgtttgtatgtatctgtgtaatcttcatgttatcctccggtatatatggttattcaataatttgtaatttttatattccatatattactgtagttttttgtcattgtaaaatatatttttcttttagtttgtcataaataaaatctatatcaaaacttgctgagcatttgatttttttatatgaggtgatataatgggcgaagcaaatcaaaaagaggtttcacaatgaaaaaaatagattttgataacgattcgataaagaaaaatatattgcaggctgctctgcccatgctggcagcccagattctaagcctgttgtacaatatagtagaccgcatatacattgcacgcataccggatatgggaaccactgcactcggtgctgtggggctttgctttcctattataatgctgacaatcgctttctccaatctctttggaagcggtggtgctccgcttttttcaataaaaagaggcatgagtgatgacagagccgccaatactataatgaatacgagctttacaatggtctgcacattcgcagttgtttttacagctttgtgcatgatttttgcaaagcctcttttaatcctgtttggcgcatctgaaaatgctctcaaatacgctctgccatacctgctcatttatttgataggaacactcccatccatgatttcaaccggcatgaatccctttatcaacgctcagggctactccactaccggcatgctgtctgtggcaatcggagccgttgccaatctggttttagacccgctttttatatttggatttaattttggtatcaaaggagcagctattgctacggtcatctcacaaatactgtctgctctctatgtgcttcactttctcaggaaaaaggccgagcttaaggtgcgccttatgacactctctgaattcagtgaaaacacgcgctatgcaaaggatatcataagccttggaacctccggctgtgtcatgcagctcacaaacagcctggtatctatatgctgcaacaacgtgctttcagtgaccggtggcgatttgtacatatcggtaatgacaattgtatcaagcatcaggcagatggtcgagactccaatttatgcaattgtggagggttcatctcctgttttaagctacaactatggcgccaaaaggccggcccgggtgagaaaatctattttcactatgggactgctcgtgcttctatatacagctgtcatgtggagtgtgattatacttgcccctcatgccctgattgcaattttcagctccgatgccaccctcatggatgatgctgtgaaggctttaaatatctactttgcggcattcatatttatggatctgcagtacatcggacagactacctttaaatcacttaacaaaaagaagcgggctatatttttctccctgcttcgcaaggtattcatcgttgtaccgctgacatatattctgccttactcctttggtatgggaaccgacggtgtatttatggcagagcctgtatcaaacgtgattggcggaagcatctgctttgtaaccatgcttagcactgtgctgccggagcttcgcaggatggagcagtaattacagcatctcatcaatgcagatgccgtagcctcctgtcggatcatcgacaaacacatgggtgactgctcctattattttaccatcctgtatgatagggcttccggatgtgccctgcactatgccaccggagagctctatcagcctgtcgtctgtcaccttaagctccattcccttgtttgtatctgttgcttttttgtctatatttgttatttccagattatatttttccagttttcctgatatttccgatatcatctgtgcactgcctgtgtgtatctcatccttaccggcaaccggataatacgtatcctctgcagcatattccgacaattcatcgccgtcaagctgtccgtaaattcccagattactattgcagtcaagtgtgcctatatggctttttttgccaaaatataccactccgcctatctcacccggcgcgccggcttttccctttttgattttggtaagcttcatgctgtacaaatcaccactgtttgcatacaagagattgccgctttgcgttccgtctcctattccatgccccagcgctccaaaacggccgtcctttgtataataagtgatagtaccgattcctgccagatcatccttcacccatatccccatatagtatttgccatcatccatcctcacaggcgtgatatccgctgacattttctcaccgcctcgaagaaatttaatgtttacggtacttttatcttcatgactttcatcatgctgcttcataatatcattcacagcttcagaaagttcctccttgtctgccacagtgcgtccattgacagataggatataatcaccgcactgcacctttttatctgccggattgactttttttccatcctcgtctgtcacctccgtcgtattcactacaagcactccctctgtctgctcatatataccggtcagcctgccacaggcatatacgccctcaacacttattccagcacttattttatctgtctcttcataatctctgtgagttgatgctgtatctgctgtctgtcctatgccttgttcggttccgccgtttccaccgtttccgccgttttcaccattttcaccattctcgcccgaatcagccaatacactggccgcctgtccgggaagccctgtcgcatatcttccatatccggcctttgattcatttaaaaaacttcctaatacactttcatcaaatgccttatctaccctgctgcaccacttatcatcactgcttagtgcaaacatagctatcactgctgcagccagcgtgacactcacaaattttccaaaaaacttccgcatactattacctccatttggattagtatgctcctgtcatttttcttttattcttttaatatcttattatctcattttaactattccaaattattttgagcaaaagccggtatagtttgacagtttaggtgttttcctatataatttcgatatatttatatgtttattataaatttcacatataattcccacgttgtccgttacaaataaataatgtaatagctttataattcttaaatcaccatttaataaaggagggattccatgaatacatacctgctcatcacatctatagtaatcttcttatgtatcctgctaaatcgtgtctccaaccgcataggcattccggcacttttagcctttatcgtgctcggcatgctttttggctctgacggaataatgaagatagatttcgacaattacgcgttcgctgaacagatatgctctaccgcgctgatatttatcatgttctatggcggctttggcaccaactggcagcgtgcaaaggctgttgccgttaagtctgtgcttttgtccaccatcggtgttattatcacatgctttctcacagggctgttctgtcactttgcccttaatatgagctgggaaataagctttctcctcggtgcgctgatttcatcaactgatgcagcgagcgttttctccatactgcgttcgaaaaagctgaatctgaaatacaataccgcctctcttcttgaagtggaaagcggtagtaatgacccatgtgcctatatgctcacagttgcttttatatccatatcccagggcagcgcaagcccgggaaatattgccatactcatagtaaagcagcttgccttcggcataatcttcggcgtcctgattgcaaagctttccatcatgctccttcgatatatacgcttcaaaagcgcggggtttgatgcgattttcatggtgggaattgctctgatatcgtatgccctgcctgcttactttgacggaaacggcttcttaagtgcctatatagtcggcattatactcggtaacacagaaatagaaaataaaaagaatctggtaaatttctttgatggcataacaggactcatgcagatgcttattttctttctgcttggtctgctttctttcccatcaaagctgccacacgtcatagtaccggcacttttaatatttatgtggctgacctttgtggcaagacctctttctgtcgcacttgtgctcacaccatttcgcagcaaaataaaacagcagctgcttgtctcatggtccggcttaagaggagccgcatccatagtgttttccatcatggcatataccgccaccaatgatgacctcgacaccttccacataatatttatgatagtactcttttcaatactgcttcaaggctcaatgcttccatggatatcacgaaagcttgacatgcttgataaaacagccgatgtaatgaagaccttcaatgattactccgaggaagcagatatccagttcatacagcttaccataccggaaaatcatctgtggtgcggtcacaagctaaaggacctgacgctgcctcctgagacactgattgtgcttatacgaagaggtgagcagaatataataccggacggtgaaacaataattctgcaaaatgatgtgctcgtgcttagtgccatcacacctgatgaggtgcatggtataaggctggtggaaaaaataatagaaaaagacagcagatataacaataaactgctgtctgaaatatcaaaaaaacacaatgagattatcataatgatccaaagaaacgggcaggtaatcatcccaaacggaaacgtacggctaaccaccggtgatatactggtaatcaaccgcgccgtaaactgataatgtcagatttttttctccatggcaagtgctttcatctcgcgtgcgctctccatcacggtatctgtgatttttgcaccgccgagcattctggcaagctcagccacactatcattgtcagttagccttcgaatccttgaaaccgtggatttgttctcgactgctttttctataaggaaatgcgcatctgccatagctgctatctgcggcagatgtgtgatacatataatctgatggttgcggccaagctcattcatcttctcagagaccatctgagctgtacgtccactgattccagaatcaatctcatcgaaaataagcgactcaatgtggtcattttctgccatgattgtcttgatgccaagcatgatacgcgacagctctcctcccgatgctaccttgccgagcggcttaagcggctctccggggttagttgatatgagaaactccggcgcattgatgccgtttgccgtatagtccggcaatctgtcaaactgcatatcaaactgtacatcaaggaaattcaaatcattaagtgctgatttaatttctgacacaagctttacagcactcctttgtctgatttctgatacctcatccgatatctgtgccagctccttttcctttttcgcaagctgctgctctaatttctgtaaataagaatcataatcattcaggacactgatacgctccctcttttcattgagtgctatcagtatatcatcaattgagttgccgtatttgctctttagatgatttatctcatccagacgcttttgtgtctcatagaaggtctcctcgtcaaactcagcctgtgatatatatcctgatatctcgtgattaaaatcagaaagcagactgtctatctctgacagctgactctccagagcttccacatcctcatcataacctgatacctgcgacagctctcttaccgccctgccaataagctctgaggcactctccatctcgcctcctgtggcagaatatgcagcatttacaccctccatgattttctttccgtttgaaaacttcctaaactgcgcctcaagctcctcatcctcaccagacaccagggaagcttcttctatctccttcacctcgtactcaaggaatgacagctcacggcttctttcttcattgtcgatatttgacttttcatactcatccttaagcgccctatatgctttgtatgtgactgaaagctgctgctttttatctccaagcggctgctttgcgtactcatcaagtatatcaaggtgttttttctttgataaaagtgactggtgctcatgctgaccgtggatatctatgagatatgcggctatttccttcattcgcgaaacagacacggcttcaccgtttaccctgccgactgcgcgcgactgtgtgattttacggcttaaaatcacgcatccgtcctcgacctccacatcaagctcccttaaagcctctataatctttgggtcctcaactgaaaaaataagctccacaaaagcaggcttttcattgtctcttagcatctccttttgcactttttcaccaagcgccagattgatagagcctatgatgattgattttccggctccggtctctcccgacagtatatttagtccgtcggaaaactcaacctcacactcatctatgagtgccagattctttacatgtagattttgtaacatattttctccttcctctcccaggcatgacgatatatgttattttctgttacagttcagctataatctgatattcatgtaacattattccacaattctgcggatttttttcatcaccgcatatgtatcatcaacagtccggattgcacacatgattgtgtcatctcctgcaatcgaaccgacgatttctctcatcttcatggcatctattgcagcacagacagcgcttgccattcccgatacagtctttataacgaggatattctgtgccatatccattgacaaaaagccctctctgagtactctttcgtatttttgggaaaggttctcaggtgcatccgttatcacagcgtacttctgtctgccgcctgcggtaggaatctttgtgagcttaagctccctgatatccctggatactgtggcctgagtcacgcgaaaaccatctttttcaagaagcgcagacagctcatcctgcgtctctacctcattcttttggattatctcaattatcttggattgtctgtttgttttcatgtcctgccacctcataaatattatttgtaactattcattataacaatccttatctgtgttatgaataatttcccatctttttgcggagtatctccaaaaagcttctctggtgaagcttgcaaatctttgtatgattggctgcctttgaaataacaaaacggtctcccacagccagctctgccgtagtgtcgccatcatagctgacacacgccatctcatcgttttgctccctgcggcttagaatctctatctctatctcatcatcgcctgaaagcacaatgctctttgacgtaagattgtgagcattgttcggtgtgagcagtatcatatcgcccttcggatccacaatcggacctcccgccgacatactgtagcctgtagagcctgtcggagtcgcaacaatgatgccgtcagcgtggtaattgtttaaaaactcaccgtttacatacacattgaggcttaaaatctgcaaattgccctttctatggatgactatatcatttaatgcaactctcgaggtctcactgcctcttttatgccctgtgagcataatacggtcctctgtcatgtatttatcagccatgagcgaatcaatagcgtcaaataccgtagcttcctccacctcacacagatagccgagtgtgccgagattcactcccataagcggaatctcaagtgtctccacccttgtggctgcacgaatcagtgtaccatctccgccgagcacaagaatacactgcgtatcctgtggtatatcctcaagctcaaactcgttatcggatatagcctcgacattgctcataagaccctttgccgtgccgcccttttgctctatgtatgccactattttatttgtaagtgcaaaatccctgtccttataggcatttgctatcacaacaaaatgtttcatagtctatttcctgtccagctctccatgcgcggcctcgaccacactatgaatatccactgattcctcctttataggatcatctgtctttttgatatgtacgaggtactctatattgccctccggtcccttgattggcgaatactcaaggtctaacacactaaatccatttgaaagtgcaaaggatatgatattgttcactacctcctcatgcacgctcttgtcacggaccacgccctttttgcctaccttttccctgcctgcctcaaactgtggcttgataagacaaaccatctcgccaccgtcctttaacagtgctcttgcaggacctaacaccttggtaagtgatatgaatgacacatcaaccgatgcaaaatccagctcatcatctatgtcattgggcgtcacatacctgatattggtcttttccatgcacaccacgcgctcatcctgacgcagcttccatgcaaactgaccatatccgacatccacggcatacacctttttagcaccattttgaagcatacagtctgtaaaaccgcctgttgaagcacctatatccatgcacaccttgccatccatcgtgatatcaaagtgcttcatagccttttcaagctttagccctccacggctcacatactgcagtgtctttccatgaatctcaatattgcagtcatcaggaaatgtgcttcccgccttatcctcacggttgttatttacaaaaacattgccctccataatcatggtctttgctttttcccgtgatggtgcaaggcctctgtttacaagtaatacatctaatctttctttcatactgtatgttacctctatctataatgctgctattatacgcttagccacggattcggcatccacatgcagctcctttttgagcacctcgacattgccatgctccacatagcagtcaggaagtgcaactgtcaacacctcaagagctatgccgttagtcttgacatactccgtcacatgctcaccaaaaccgccgctttgcacgttttcctccatagtcacaagcaggctgtgttcagccggcaattccttaattgtttccttatcaaaaggcattgcaaaacgcgcattgataagtgtagcagagattccctcagcctcaagcagctttactacatcaacggcagtctttaccatactgccgagtgccatgatagccaccgtgcttccttttctgattagctcactctttgcaagctctatcggctgtctgatttccttaaggccgtcataggctgcccctcttggatatctcagtgcaatcggaccgtcatatgccactgcaaacttcatcatatcagacagctcccacttattcttcggagccatgattgtcatattcgggatgaccgacagatatgatatgtcaaatattccctgatgtgtctctccgtcactgcctacaagccctgccctgtcgattgcaaagatgacatgcagattctgtatgcacacatcgtgaagtatctggtcaaacgccctttgtaaaaatgacgagtacaccgcaaataccgggataagtcctgcctttgcaagccctgccgcaaaggtcgtggcatgtgcctcggctattcccacatcaaaaaatctatccgggaaattgcggtggaatctgcgaagccctgttccatctgccatggcagccgttatcgcaactacctttggatttctctcgcccagcttcttcatgactgttgagaagacatctgtgtaattggccttcgtgcgcttattctttggaagtcctgtctctatgacaaatggctctgcaccgtgaaatctggaaggataacgctcagccgggccatagcctgatccctttttcgtaagcacatgcacaagcaccggaccatccacacgctttgcctcatcaaacacacggcacatttcctttatatcactgccatccacaggtcccaaatagataatgcccatctcctcaaagaacatacccggaataaaaagctgctttatgctgctctttgtattcctgatatgctttaccatacgctctccgtagatcggtatatggtttagggaattcatgacattattcttaaaatccctgtatgcatccgctgtgcgaaagcctgaaagatactggctgatgcccccgacgttctctgaaatcgacatattgttgtcgtttagcactataataaaattgcctttaacgcttgaagcgttgttgagcgcctcatatgccatgcctccggtcagcgcgccgtctccgatgactgaaaccacatggtagtcatctccggtcacctgtctggctgtcgcaagcccaagccctgctgatatggatgtggagctatgtcctgtattaaaacagtcacagtcgctctcatccgcctttgggaaaccgctcatgcctccatactgtctgagcgatgaaaatccatcctttctgccggtgagtatcttgtgtgtgtacgactgatgccctacatcccacactatcttatccttcggcagattaaagcacagatgcagcgccatggtaagctccacaactccgaggtttgatgccagatgacctcctgtcaccgatatgctctctataagaaactgcctgatttcatcctttaacagctcaagctcctcaggtgtcagtttttttatatcattttccttttgtatcttttctaaaaccatcttatttctcccgatggatcaaatattcaaatagctccttaagaaatgcatcgtcgtatcccaaatcatcaagctgctcctctgcctccttggagatgcgctccacatcagaaaccgctttatccaatccctcaaatgtgacatatgtcgctttattatttttctcgtcactgcctaccggctttccaagcacctcaagtgtacttgtgacatcaagcacatcatcctgtatctgaaacgcaagccccagctttgccgctatctgctcaacgcgtgatacctcatcagacgacgcccctgcaaggattgctcctatcatcatcgagctctctataagtgcgcctgtcttaagcctgtagataaagtcaagcttttcccttgtgatagaacagtcatcggatttctcgctttctacatcaaccacctgtcctccgaccataccatacacgcctgccttttttgcaagcaccgcaaatgcccttgccacacgcgtatcagccacttccatgtcaaaagcctttgctgcggtctcatatgccaggtttaaaagtgcatcacctgcaagaatgcccatagcctcaccgtacacagcatgtgtggtcttctttccacgcctgtactcatcattgtccatggcaggcaggtcatcatgcaccagcgagtaggtgtgtatcatctcgattgccgccataaatggctcaatcactgcactgcttccgccaaacatatggtaagtctcttccatgaggatagggcgaagcctctttccaccggctctcacactatagttcatggcctcaaaaataatcctctgctgtccctcctcaacgggaagaaacttctcaagcacgttatttatatgctctaccttttgctgcagctcttccatgaattgtgacttatttaaattcccatttaagctcatcagaattcctccagttgtccgtcgctgtttagcacaagcatggccttttccatgccctgtaccatatcattggcactctttacctcatcaagccccttcttgtagagctcaaaggcctcatccagggatacatccgcatcctccatcctcgccactatctgctctaagtgtgcaaagcgctcctcgagtgtcagtgttttttcattttctttgctcatcgttaataacctccgaaactacggcccttgcatgaccgtctatcagatatatatttatgtcatcgcctgcattgatatcggatacactgtgcagtgcccccttcttttccacctcgacatacgcatagccctgtgccagttttttggccggtgaatatgcatccagtgtacctgaaagcagcgccagacgctgtctgcaatccgaaagtctctgcttcataatcctttcaagtgcatcctcgatatctgccagacgccttttattctcatttagtttattctgcggactaaggaaattaagtcttgttttaatatgtgacagcttttccctgaaaaaatcaatccggcctgtcagatttctgtccatcctgcggcgcagattgtcaaggcgctctaacgtctgtctgtagtcactgactgcaagctctgcagccgctgaaggtgtgggtgctctcctgtctgacacaaaatccgctatcgtccagtcagtctcatggcctactgccgagatgattggcgtgcggcagtcaaatatggctctcgccacaatctcctcattaaaggcccataaatcctctatggagcctccgcctctgccgactattatcacatcaagattcatcgcatccaatgtctgtatgcccttcactatgctatcagccgcaccttctccctgcacaagtgccggataaagtatgacctgtacatatggatttctgcgcgatgatacattccttatgtcctgcacggccgcacctgtcggtgctgtaaccacaccaatacggccggcatactgcggaatgggctgcttgtactctgcggcaaacatgcccatttcctcaagctcatgctttagctgctcgaatttgagatacagattgccctctccgtcaagctctatctttttggcataaagctgatatgcgccggttttctcatacacctcaacggaacctgtcacaataacctggtccccctccttcatgtggaaggaaagtcctgccgccctgctacccgcaaacatgatagcgttcatggctgctcccgcgtcctttattgtgaaataaatatgaccgctcgtgtgatacttgcagttgctcacctctccctttatgctcacctgtctgagcataaaatcctgagcgaacatatttttaatatagctatttacttgcgctaccgaatatatatttctatttgccatgtttaatgctctatatcgctgttcctcttaagctatgcaaactttgcaagcactccgtttacaaatgcacctgactcatctgcaccatacttctttgcaagctcaacagcctcatttattgaaacttttgtaggaatatcgtcctcaaactttatctcataaactgccaatctgataattgccagatcaacctttgccatacgattggtcttccagcctgtagacttctcatcgatgagtgcatcaagctctgccatatgctcaataatcgcactgcatttttcatcaatatactgtttttcctcgtctgtaggatttgtaagctcatcatttaaaagctccatctgctctgcaagctcagacttgtcatgaaactcaaccctgaaaagcatcttaaaaacgttttctcttatcttgcttcttgtcatttaaattcctctcgtgaatagtattttatataaattaaggatgtctgtacgacatccttaattatactacatttgtgatcatttaaaaagaactatttaattctctcccatatcaacacttgctatacgaacattgatagtagccacagaaagccctgtcattgtctcaattgcagacttaaccttctcctgtacctttgtagaaacctcagggatgctgtatccataagcaatattgagtgctacatcaaccactacctcattgtctgctatctcaatctgaattccctttgagagattcttcataccgagcctgctgacaatctcgtttgtgatattgcctgccatggagcttactccctcaacctcagtagcagcaagacctgctatgatagctacaacctcatctgctaccttgatctcgccagactcatctgatttgatatttattgtgtttctattctctgccatgtccatgttcctccttaaccggctatacggtctgtccctttgccacgtaaacctggaatgagtcatttcccgtaagtgatctatttcttgatacgcgaacattcttgtctgtgatcacgtactccagattggcgccatcctcaattaccgtatcctgtagcaggatgcagttcttgacctttgcattctttcctatcttgacgcctcttgataggatgctgttttccacggtaccctcgatgacacagccatcagcaaccatgacattcttggcttttgagccatttatgtatcttgtagggttatcatccctgatctttgtataaatagagttgccactcttaaacaatgcttccctgttatcctcatcaaggagcttcatattctcctcgaaatagctcttcatatctgtaatctgtgaagcatagcctgtgtactcatatgcctggatattgagtgaatcagtgtttgtagccatcagatcccttgtaaaataagaataaccatgtacaaaagcgtcatccactattctaatgagcttctccttctccatgatatagatattcatgccaaagtttaccttgcccatatccctgtcattgatatatatctttttgatacgtccatcatctatatcaaatgtatagtacatctcatcattgttgccgtttggtcttaagaataccttcggtacctcctgcttgcggtacattgcagtgatatcagcccctgtgttcttatgtgcctcaatcagctccctgaaatcaaaattgaatacatagttggcatcagccatgataacatacttctgagtgcactttctcagataacccttaaggctttcgattgcctcaacacggccctcatacaccttaatctgcttctgtgcataaggcggaactatattgataccaccattttttcttgcaagatcaaactcctgacctgagcccagatgatccatcagagagtgatagttcttcttaactatgagagatatattgtcgattccgctatgtaccatgcttgaaatcaggaaatcgcagagtctgtaacgacctgcaaacggaatggaagccataagtctctcggataccatctcagggatgagggcatcgtagctgtttgcaaaaataacggccaaagcctcttcgttgttcatgtttagcattgttcctggccctcctcaacatcattatataccatcgcctttggtcctataaccgctctgtcgccaattgtaactcccggtgcaattgtagcaacatcacctgtcacgtcctccgccggcttttctccaataactgcatcacagcctactgtaaccccctctgcaactatacagtgtgtgaccttagcgcctctttttatcacagtatcacccatgacaactgcatcctctaccacagcgccctcttctacgatgacaccgccaaaaagaattgaatgctttactgtgcccttcactacacagccatcggtaatcatagagtctgtaacctctgcgttgttgccgatgaaatgtcctgtatgaccgctgttacggctgtatatcttccagttctcatcaaacaggttgataccgctgtgctcaggatcaagcacctccatgtttgcctcccagagtgcaggtattgttcctacatccttccagtagccgttaaagtgataagcatacatcctgcggccatccctcaaaaggtttggaatgatattgttaccgaaatcattctctgaatccggatcattttcatcctcgataagatacttcttaagtatatcccaattgaagatataaatacccatggatgcaagattagacttaggattctttggtttctcctgaaactctgtgatcttgtcgtcatcatctgctaccataaggccgaaacgtgatgcatcctcccatggaacctccataactgctacagaaaactcagcatttttctccttatggaacttaaggaaatcgctgtagtcctgcttacaaatctgatctcctgaaagtatgataacatactcaggatcatatctctcgataaatgcaatattctgataaatcgcattggctgttcccttgtaccagtctgagcctgaagccttctgatacggtggcagtacatgcactcctccatataatctatcaagatcccatggctgtccatttcctatgtactcattcaaaacaaacggctggtactgtgtcaatataccaactgtatctatacctgaattaacacaattagaaagtggaaaatcaataattctgtatttgcctccaaacggaactgccggctttgcaagtttctgcgtcagtgcataaagtctggagccctgaccaccggcaagaagcatcgcaactagctcttttgccatattaaaatcccccttgtttaattttattaaatttttgttagcttttgcaattattttggttttttataatggtttatagttatattttaccacactttggcatttatgcaattcaaaattaactaaaaaaaactataatttttgtcattattttccaattatctcgcggttgtttatgaactcgtacggcacctcctggtacacataataattaagccagttggaataaagtatattgccgtgcgaccgccactgtaaaagcggcttttgtgtatcatcattatccggatagtagttcaccggcatatctatatcaagtccctttttcttatccctctcgtactcattgtgaagagtatatctgtcatactcaggatgtcccatcacaaaaatctttttaccgtcctgatccatcagaaggaatactccggcatcatccgactccgcaagtatggtaagctcaggatgctttaatatatcctcctttaagacctcggtatgccttgagtgtggtgcgtaaaacacgtcatcgaagcctctgacaagtgggatttttctgttctttacacggtgcgcatacacaccaaacttcttctttggaagcacacgctttggtatgccgtagtgataatataatcctgcctgtgcaccccagcacagatgaagtgtggagaaagcatgtgtcttgctccactccattatactgcatatctcatcccagtagtctacctcctcgtattccataagctcaaccggtgcccctgtgattatcatgccgtcaaagtatctgtcctttatatcatcaaaggtctcgtaaaatttgttcagatgactgagtgatgtgtgagtggcctcgtgagtagatgtggtaacaaacgttacattgacctgtataggggtatttgacagcgagcgcagtatctgaagctctgtgtcctcctttaatggcatgagatttacaatcgcaatctccagctgtctgatgttctgatgtgatgccctgttttcgtccatcacaaatatattttctctctcaagtatttcctttacaggtaaatcattttgtgtctttataggcattttataacctcttttctaacgcccaaacatctctataaatgtatcctccgagatgataggtattcctaattcttttgcttttttattttttgatgaagtagattcagtgtcgttgtttaccagatagtctgtcttttttgacacgcttcctgtcaccttgccgccctgtgactccacataggccttaaactcgcttctgttggcaaaatcatgtacatcgcctgtgataacaaaggtcttgccgtttaagcttccctcagacatatcctttatatcgaccttttctatgtcaagctccttaatcagtgcttcaaacatcgtactgttttggggatttgcataccattcaagtatggagcctgacttttcctggcctataccgtctatatccacaaaatctgtggcatttctcattctgtccgcgaagccatcaaagcctattgcgttgacaatcttcttgcctgcatcggtacctataagaggtatacagagtgcaaatatcagattgaccgggtgaacatgtctgcttttttcgatggcagtctgcatattcatgcatgatttttctccaaagccttccatgctgcttatcttatcaaaatgctcgggcagatggtatatgtcagggaactgttttatgaatccctcatttataaattttagcattgtctgtaccgaaagtccatctatatccattccgcttttgctgacaaatcttgaaaactttttaacattcttggctgtacagtcaggatttgtacaatgcagcgtcttcacaccgctgtttttactcacaaatatgcgtgtcggatgatgacacaccggacattccttcggtatctcaactgctcccaccgcatcctttacagctatgcattttggaataatcttgttggcttttatcacggaaagggtacactcttttcccactccaagcctttctatttcagtcagattacaaagcgaagctctcgaaaccgtcgtaccctctatctgcaccggctcaaaaacagccaccggcgatattgtcgaaactgcacacgaccattcaatataacgaagcctagtatctacagcctcatcctgccacttgaaagcaaagcctgctctcgtagcatgatgccctgtgatgcttccgcctgcagcgtaggcagtgtcatcatagcatatgacaagtccgtccacaggcacatccatcctgccactctcgacatcccttgtccagcgttttacagcctcatcaaggcctgccgcatctgttgcctcccttttgacaacattgaatttcatatcactaagatagctcattctatccccccatgatatgatatcatcatctatatgcacgagtgtaaacgcataaaacactacatgtctgcgcttcacctcttccacatcatcgagatttaatgtaccggatgcaaggttccttggattggcatatttctcatcatcgtcctcgattgtatcatttaacagcttaaaatccgtgtaggaaattgtcgcttcccctcttacaaccatatgtcccttgtatggtatctcctttgggaagccgcttatggcatcctgcaaaaaggtgatgttacttcctacagttccatttcctctcgtcagtattttcacaagcctgccaccgtcatatgtgagcacgagtgtcagtccgtcaagcttccatgaaagccagattggcatatcacctgcccatttcttaagctcctcaatgctctttgtcttggcaagtgaaagtgccggatactcatgcggctcacgatttccagcctctgcctcatagcctgcattctgtgtcggactgtcatggcggatatatcctgtctctttttcaagctgtgtaagctcatcaaacattgcatcccactcgtagtttggcattatttcatctgcgccgttgtagtaagcttttgacgcgcggttaagactttcaacaagctcatctatcttatcttttattttgttattctccatgctgtaataatcccctgtctgctttactttgctcttctatccggatatttcttatctgtatgtttcttatccgtatatttcttatcagaatgattcttattcgtatcaggcataaccggctgattcgaggaatccgcaatcagtcttttgagccccttgtattcaagtggtgtcactgccctgtactttcctcttggcaggtcaccaagctcaatattcatgattctcactctctcaagcttaaccacacggtagccaaagtattcacacatccgtcttatctgtctgttgtagccctgtgtcagaataatcttaaactgctttgaggacagctttttcacatggcactttctggttgtcacaccaagctctacaagcggtacgcctcctgcgagccctcttatgaagctgtcagatattgttttgtttactgtgacaatatactctttttcgtgtctgttgccggagcgcatcatcttatttactatctcgccattgttggtcagaagtaaaagtccctctgaatccttatccagcctgccaatgggataaatgcgctttgggtaattaagataatctatcacgttgtttttttcccttttttctgctgtgcagactatgccggccggcttattgagggcaatcagtatcatctcttcttcctttgatactacctgtccattatatgtgacagtctgtccctttagaactctgtcacctgtctttgctgtcacgccgtctattcctactttgccggcttctatctgcctgtctgcctcacgccttgagcacacgcccgcttcactgaggaatttatttattcttacaccattttcttccataccatatcctctttttagattgctttatccgatatacataaaccaaacagcagccttttctactctttacagcagccatttgctatgtagattaaaacacggagacctttaagcctccgtgttgcttcttatgattgtatgcacatctgttactttatattgcttttactgtcctactgtctggagattctctgtcttgatataagctctgccatttgttccggcgctgtaggatactatagtccagtctccctctgtgccatatgctgtaagtgttacctgttcctttaagagaccaagctcctttgcatctgtgcttgcaccgtcacgtacctttacaacatcctttgtcactacctgatactcagccggtgcctgtggctgctcggctgtctgctgattggctgcatttgtatctgtggtctgttgatctgtggtctgtccggcatttgcatctgtggtctgctgatctgtggtctgtccggcatttgcatccgtagtctgctggtctgtagtctgtccggcatttgcatctgtagtctgctggtcgccactctgtgatgcatcatctgcctgctgtgtatctgcctctgtagtctgtgtgtctgcatcagacttctttaaattggcaatgcccgacgatgtgtaccactgctttatagcacctgtgagtgttgtctcaagcatagtctttaaattggcatcagaaccgaccgcctgctcatatgccttttgtacctcctcatgcaggtctgcaaactcagatgaagcagtatacttagaaataagctccataatatcgtcatcgagttcattctcgcagtatgttctgttgaaattactgtatacattgtttataaagagctttccgtccttacctgtctctatataaaagaagtcaagtgtaggtgcctgtgtatcaactcccgtaaactttatactgtttttaacagacacaaagtatgttccctttttcaaaccgttcttggtgtaaggtgtgatgtcattgactgactcatagtactggctgacaacaccaatatagctcttctcgttgtcgctcataggtgtcgcaagcttgccaagtgtatcaaggtcatcacccacgtatgccttgtaataatcagcaagtaatgtgctgatatcgtccttggcgtcatttgtgtaatccttttcaaactcaaaatccttcaccgaaatctctgtctgtgatccggcttcagtattggattgtctgccattattgcctcctgcgacaactactataagtataagtatgagtcctacaagtacccctgctactccaacgtattttttattttctgcacaaaattgctttatattatccaatgtttccttgttaaaaaagtccttcatatggttcctccattaacccaacatatcaaaatcaaagtatgtgaccgacgcgaatcgaacgcgcactcgccggagtcggagtccggaattttatccattaaactacggtcacaaaaaaagttaccaactatttatatcacatcttttactttttttcaatgttacttttagtcttttagtgttttattataacttattatgcatactattataattgataaaaatttgacaatatatttcatttatcttattatttaactgtttgggcattatatattggaaattttttccgatatgccataaaaatataccattttaattaatacaattactatttatataaggagcagtattatgagtttcacatttttaaaccagcttccaactcctgcacagattaaggaggaatatcctctgtcaaaggagcttaccgagcttaaagcgaagcgcgatgcaatgatttcagatgttatctgcggaaaagatgatagatttctcgtcattatcggaccatgttcagccgacaacgaggattcagtctgcgactatgtcagccgtctgacaaagattcaggaggatgtaaaggaccgcgtaatcatcatccctcgtgtatatacaaacaagccaagaacaaccggcgagggctacaagggaattgcctcacagcctgaccctgagaaggctcctgacatggttgagggtcttatcgccatgagaaaaatgcacatccgtgccatcgcagagagtggactcacctgtgcagatgagatgctttaccctgagaactggggctatgttgaggatcttctctcatatgtggcaatcggcgctcgttctgttgaggatcaacagcatcgtctcaccgtcagcggcttcgatgtggccagcggcatgaaaaaccctacaagcggtgatttttccgtcatgctcaattctgtttatgcagcacagcacccacatcattttgtttacagaggctatgaggttgagacatcaggaaatcctctgactcacgttgttttaagaggtgctgtcagcaagcatggcaacactacaacaaactaccattacgaggacttaatccgtctgcacgaaatgtacgacaagatggacgttgtcaaccaggcggctatcatcgataccaaccattccaactccggaaagaagttcaaggagcagattcgtatcgccaaggaagttatgcacaacagacagctttcctctgatatcaaatcacttgtcaagggtcttatgattgagggctatattgaggagggcagccagaagattggtgagcatgtctacggaaaatccatcaccgatccatgtctaggatgggaggattcaaagaagcttatctacgacattgcagagatgaattcttaaaccacaaattatacacacatttttttacaaaacacaagccacatgagtatatatcctgtggcttgcattattttatcggtttattatttaatcatattactataagcaagaactgcactgactgttttggaatcctggattttcccggcataaatcatgtcgcacagctcctttagggtgtatatttctacatcgattgactcggcatcatccagatgctgcttgccctttttcaggtttttggcaagatagacatccacttcttcgtcacaaaaggctactgttgtgcgaagcgaaagtaaaaacgagatatcgtcagagctgtagcccgtctcctccttaagctctctttctgcacacagtctggtatcttctcccacaaagtctctgcagccggccggaatctctattgtctccctctcgagagcatttctatactgacgcaccatgattatcctgccgtcatcaagcaccggaagcactgccgcagcgccctttctgtgtgaaacaaaatcccattcctcagtcttaccgtttgcaaactgcattgtatccttgtatatatcaagtattgagcccttatatacaagctctcttttttgccgtttcatttcatcaatcatttttcctgtttaccttctaaataatataaattcagagttaccgttttgattagaaatccacctctgtatcataatagcagcatttgagaagcttctccatctcctcctggcttggctggcgaggatttgagcctgtacaagcatcaaggatagcatttgcagcaatctcaggaagtctctcaaggaatacctcctccggtacaaagccctgctctgttggatagctgtctgctccataattcttgatgcagtgtgggatattcagatcatcattcatgccacgtaagtatttgataagaagctcaaccttctcatcaagtgtctctccacccagtttcatgaaatctgctattacgccatagcgttccttcgctgtctcatcctttgcattaaaagcaataacctttggcagatacatggcattggctgctccgtggatgatatgtgcaccataatctgcaaaagctgcgcctgtcttgtgtgccatggaatgaactattccaagtagtgcgttggagaatgccattcctgccagacactgcgcattgtgcatcgcatctctctttgccatatcaccattgtatgaatcaatcaagtcatgctgtatcatctctattgcatggagtgcaagcggatctgtaaagtcactgttggctgttgatacatatgcctcgatagcatgtgtcatggcatccattcctgtgtgtgcaacaagcttctgtggcattgtctctgcaagctcagggtctacgattgcaacatcaggtgtaatctcaaagtctgcgattggatacttgatacccttctcataatctgtgatgattgagaacgcagtaacctcagttgccgtacctgatgtggatgaaatagcacagaaatgtgccttctctctaagctttggaataccaaataccttgcacatatcctcaaatgtgatatccggatactcgtacttaatccacatagccttagctgcatctataggtgaaccaccaccaattgctacgatccagtccggttcaaactcagccatggcagccgcacctttcatgactgtctcaactgacggatccggctctattccctcaaaaagctttacctccatacctgcttccttcaaataagcctcggctttgtctaaaaagccaaatctcttcattgagcctccgcccacacagataatagccttctttccctcaaagctctttaatgcctcaagcgcaccctttccgtgatataaatctcttggtaatgtaaatctctgcattgtaaaaccctccatatgatattttattatatagtttctcccttgtaatatttataaatattgcagccatcaaatacttaatagttgctaaatattacacttaccattttataacattttactaattttgtcacgtaccattatctatttttgtgaatacaagatatcttatacatatatttttatgcaatatgtataattttcttcaatagtaatgaacagttaccgataatttatttcataccataagcactacattataaaaatcggctgcatttgtgtttttcatatgttttcatacattttagcaaaaagaaaaggcttcatacgaagccttttcaaatgtacatgttattatgtcaaaccgacaatacgctaatgctctactttgcgtaatccactatacgtgactcacgtattacattaacctttatctgacccggatactctaactcagactcaatctgcttagatatgtctctggccatgataaccatgtcggcatcgctgacctgctcaggaactaccataatacgaatctctctacctgcctgaatagcaaaagatttctctacccctttataaccatttgtaatgtcctctaactgctgaagacgatttgaatatgtctccaaagtctctcttcttgcacccggacgtgccgcactgattgtatcagctgcctgcacgagacatgcaataagtgactccggttcaacatcaccgtgatgtgattctactgcattaatcacaagtggtgactctttgtatttcttacataattcggcaccgagctggatatgtgaaccctccatctcgtgatctactgccttacctatatcatgtaataagcctgcacgctttgccattctgacatcctcaccaatttcagcagccagtaagccagtcagctgtgcaacctcgatagaatgctttaacgcattctgaccgtagcttgttctaaacttcatctttccaagaagacgcacaagctctgggtgaataccatgtatgcccacctcaagtgtggcagcctcaccctcttcacgaatcatattatcgacttctttttgagccttctcaaccatctcctctatacgggccggatggattcttccgtcaacaataagcttctcaagagctattcttgcaacctctcttctaattggatcaaagcttgacaagataactgcctcaggtgtgtcatctataatcagatctacacctgtcatagtctcgagagtacggatattacgtccctctcttcctatgatacgtcccttcatctcatcattcggaagcgatactactgaaatagtagtctcagacacatggtctgctgcacatttctgaatagctgtaaccacgtaatccttagccttacggtttgcctcttcctttgctttgttttccatttccttaatcatttttgcagtatcaagttttacatcttcttcaatggtctttaagagatattctttagcttgctcggaggttaatccagagattctttcaagttcctgtaaacgctgctcgttaagctttgatatttcaatcttctgcttcttgagttcctcttccttaactgcaaatccggcttcacgcttctcgatagcttcgagcttcttgtcgacattttcttccttctgaacgatacgacgctcattacgggaaatctcgtttctacgctctttgatttccttatccagatcattcttagcctttatagactcttccttgatctcaagcatagactcgcgcttcttttcctccgcagtctttacagcctcatcaatgattcctcttgccttctcctcagcatttcctatcttggagttagcagatttcttctcgtatgaagcggctgcaaaccatacaatcaatgcagtaataataatagaaactacagcagtaatgatatacggtagcattacaggagcacctcctttattaaattttcattgtatttcacaaattacaacaattaaattctatactttttggtgcaaattgtcaaggtaattgtgacctcattgcagaaagaatctggctgctcttaaagcccctgcgcataagaaactggtatatcctgcgaaactccttttcatcacagttatcaggatcatagtgtttcttttcaagcagctttgctatatgtttctcttcatcagcagtgtattcgctgtctatggcacaatttatatcatctctgcctatgccctttgccataagcttctgctcaagctgcctgcggcttaagctgtcctgatgatacctgacatatgtggaagcaaatctgtaatcatcaagataatgaaagctcttgacataatctatcgctgcatccacacagcaatccggatatccgccctgtgtgagcttttccctaagctttctttcactcctgtccatctgttcaagcagatgcagtgctctctttttggctctctttcctaccacctcagatatcagcttttcgtaatccgcttcactgataaaggctccctccataatagagtaccgcacggcctctgtacgatacagcacacatgtcgtgccattatcaaaggtcgtgcggtatttgcctttaccaatattctcatatccggtaatctctatcatatataaccctactcacttattattcttctgcttcagacttttcagagtcttcctgtactgcagcatcttcatcctcaggctgtgtaaagtaaaaatcccttacctttgcctcaagcatatcaaaaaatgccggattctcatggatataagtctttgcattctcacgaccctgtcctatcttgtctccctcgtatgcgtaccatgcaccggatttgttgacaatgcctgcatttactgcaagatcaagcacatctccttctcttgagataccctgtccaaacatgatatcaaactctgcctccctgaaaggaggagctattttattcttaacaacctttacgcggacatggttgccgactatctcaccgccctgcttgagtgactcagttcttctgacatcaagacgcactgatgaatagaactttaatgcccttccacctgtggtagtctcaggatttccaaacatcacacctaccttctcacgaagctgattgatgaatataacgatacaatttgacttgctgataactgccgtgagcttacggagcgcctggctcataagtctcgcctgaagacccacatgggaatcccccatatctccgtcaatctcggcctttggtacgagtgccgcaactgaatcgacaaccacgatatccacagcgcccgaacgtaccattgtctctgttatctcaagtgcctgctcaccgcagtccggctgtgaaatatagagattgtcaatatcaacacctatatttctggcatatacagggtcaagcgcatgctctgcatctataaagcctgcgatgccgcctcgcttctgtacctctgcaacacagtggagtgcaaccgttgtcttacctgatgactccggtccgtacacctcaataatcctgcccttcggaagacctccgagtcctaatgcaatatcaaggcttaatgagcctgtaggtactgtctctacattcatattggctgaattgtcaccaagcttcatgacagagccctttccgtattgtttctcaatctgcgcgatagcagcgtctaatgcttttaatttatcttcctttgccataataatctcctattctctcgcgaacaaacgttcgttctgttattataataatacacttctattcaattgtcaactaataaattggaataattacagaatcagatagctgcccgtgctgctgtttgtgcctcacgctatactctaaaacagctatagctaaaatactcaaaaatatacaaataaaacataattaaaaagacagttgctttcacaactgtcttcattatacacataatctctcactaacgtcaagtccaaattcaaccttgaaatccttacctagtttcttccaaactcagtaagcacaagtccgtcatttctatcgagtgtcatgccgatgctccactcattgatgaacagaagaagcggattgcccttcatgtcgacaaccttcttcatgtcgcttgttccgttaattgtatctacattgacctcatccttgttctcaatccatctgatatgctcatatggcagattctctagtctgatctgcacattgtactcattttcaagtctgaatttaagcacgtcaaactgaagcacaccgaccacgccgactatgatctcttccatgccgcccttgtactcctggaacatctggatagcaccctcctgcgcaatctgtgtgacaccctttacaaactgctttctcttcatggaatcaacaagtgataccctcgcaaaatgctcaggtgcaaatgtcgggatgccctcaaactcaaatttatcctttgctgtcgtgagtgtatctcctatagagtatacgcccgggtcaaacacacctatgatgtcgccagcatatgccttgtccactatttttctctcatctgccatcatctgctgcggctgtgaaagctttaggctcttgcctccctgcacatggtatacctccatgccggctgtaaactgtccggagcagattcgcataaatgctattctgtccctgtggtttttgttcatgttggcctgaattttgaatacaaatgcagaaaaatcctctgaaaaaggatcaatcattccgatgtcagattgtcttgctgtcggtgcatatgtcatcttaaggaaatgctgtaaaaatgtctcaacaccaaagtttgtgagagcagagccgaaaaatacaggtgaaagctctccctttgtgacaagctccatgtcaaaatctgcactggcgccatccagcagctcaatctcatccatgagctggcttttaaattcctctcctatctcatcggaaagagccggatcatctatatgaataatcttctccgagccctcttttgtaccctttaaggtatctgcaaatgtcatgacctccttgctgtttctgtcatacacacccttaaactgctttcctgagcctattggccagttgataggacatgtcgcgataccaagctctttttcgatgtcatcgagaagctcaaacgtatcgttggcatcacggtccatcttgtttatgaatgtaaaaatcgggatatgtctcatgacacagaccttaaagagctttctggtctgtgcctcaacacccttgctcgcatcaattaccatgacggccgaatcggctgccatgagtgtacggtatgtgtcctctgagaaatcctggtgtcccggtgtatcaagaatattgatgcaatatccgtcataattaaactgtaatacagatgaagtaaccgaaatacctctctgcttttctatctccatccagtccgaaacagcatgctttgccgtagcctttccctttaccgaaccggcctggtttattgcccctccgtacaaaagaaacttctctgtcagagtagtctttcctgcatccggatgggaaattattgcaaatgttcttcttttttctatttcctgtcttaagttatccactgatatttcctccaaacaaaatcagagtatagtatagcttaaaacggttcccatttcaagacactaaaaatttatgtatcagtccatcgtcgatatgacaatatttgatgccccgatatttgtcttgcgcttgataatgtcctctatctgagctctcttctcatcagtcacatcgtcctttcccacaatcacatcacagcattcatcactgagacttaccacagcattcttaaatccctttgcctccagcatcatctgggcatcctcctccatctgtgcattttctgtcagcttcaccatggcatccaccgcgctcttcttctctgcctctgacactcctgcatcatcgataatcttctgcagagcctccttgttctttgagcgcacctgctcgcgtcccagcttcacctgtgccacacactcctcgctctctgtggatgcacttgtcagtaccgtttcgccggcatttaatatttcctctgtcgagtctgtctcaagcgcaacctcatctgatgcctgtgtatcctcacattccttagactcctttgtatccgcctttccatttacagcttcgatttcagtggaaagcacatcctttgcattcataaaggtatccctgttatcatagcttatgtaaccgaccactgccaaaagaagtgcaagtgtcgtaataattatctgattcttatggctgcctttcttcacttttattcctccctggatatcatttttgctatttttattttatgcatgggcacatcaaataatgcagaaaccgcattagaaatatcgttgtttacctgtgggcttcctccgccctgcgctaccacaagcactcctgaaacagtcggtttgtccgtgcttgtgacataaggtacgcttgcatcctcgtcatcgtatatgaccgtagtcttttcaatactctccgaggtctccttagtatccttatccactatccttgtgccatcgtctgacagcgtaatcatcacagatacctcacccacaccgtccatcctttcaagaataccctcaagctttttttcaagcagcttctcatattcttcatcatcgcaggtgctttcacttactgacttggctttagctttcttttgtgaattactacaggtctttctatcctcttttaccggaagcaccacaataagaagcagtactccaacaagtaaaatcactatgtagtcagttttcttcagcttcgaaagccgtaaacaaatctgtcgtatccgcgtcatattcatacgaaatcccctctattttctttgtaagctcagcaaatctcatgtcatattcataccctgccgcaagaggctttagaataatgaccgccaaaaacaccccaagcataaacctaaagtacctcctgtactgctcctttggcgttaaatatgtcattaccatgaaaaaaaaagccagatacaaataactcttcatgccctatcaacctcccataaagcttgtagatgcacatactatcgcaatcactataaaaaacaatatagatgcatctcttatcacgatataatacagatttcctgccctggcaacggcttctatgccctccacaatcctgttgtctgaaaccggctgcagcgccgcggaaagcaatctgtacatcagcgaaaagattagtgttttcacaagcggggtcagcacaatgaaaaaaagcacgataatcgccgccataccaacactgttttttatgagcatcgcacagccaagcataatttcacctgcaccctgtccaagcctccccacacccggtatcgcctgaaaactttttaagataaggctttccgatattttgtcctttgcgggagcaatcatggcctgaactatgcctatgcctgccactatctttatggatgccttcattatttttgtaactgctgattcaataaactctgcaagcttttcaagcttcttttcactagatacgtgattgagcacctcaagcaccagaaacagatgaattcccggtatgagcactagctttataagccactccactacataaatgagcacaaatgccagcatgtaaaagcctgatgccgaaaatccttttccggacgcaagaagtactgtcgcatatgccggcacaagcgctgtaagataagtcaaaagcacatcaatacagccctttgccacatcagacaacacaaaaaaagatgccataagcattgatataactgatgcatacataaacagaaagcttacattgtatacataatcctgccgccagaaaataagccttgaaaacaccataaaaagtatcgtatagcacagcacatttataataacaggcttcaccgccgctatctcataaaaaaacagctcataaatatactcacagattttttcaccggccttttgatctcctgccagaatggcatccactatatccgaaaacgatagtctgtccggcagataatcctttgaatatttttcaatctctgacatatctattttttcaagcatctgctgctcaattttatctgtaatttcggtgtccgacgcatacacaaaacactgcggcaaaaacactacagccaatatgattattatcaaaatatattttttacaaatcaaaacagctctccaatcagctctatcagacaagacatcaccggaattgacatcacaacaattgctcccttcgcaaaaagctctatctgcgatgcaattgcgctatgaccacagtccttacagattgaggatgaaaactccgcaatatatgcaatcccaagcatctttaccatagtgacaaaaaatgccggttccacaggaagctttgaaagaagtcctttaaaaaactcaattgtcgtgccgagccgctccaatgcaaaagcaaaaattatagtgccgcaggccactgaaagaagcattgaaagctcaggcctgtcacgctttaaaagcactgcaaaaaatactgccgcaattcctattatcccaatcttcaacatattacaaagaaaacatatcctgcattgccttaaacagctcacttatatatggcacaatccagaacaatacaataacaagcccggccagactaagcaggaaagtcatttcctcccttccactgtgttttaagacctgtccgagcaccgtaatcactattccaagtgctgctatcttaaaaataatcgaaatctccatcatcaagtcctttcatcgcatacaacaatatgtttaatcggattaccacatttttatacaaacatttttttataaacaatattatataagcattattgatatcataatccctcccaaaatacccaccggacaaatcaccttcattttttcaacataatctttcctgtaaaaatctatctgtttatgtatgtccaaagcacattccttaagccgctgctccatcgcagctgcatttttttcaaagaatgcacctcccatttcaactatcattttctttattttttcatcagatacccggccccaaagtaccttctcccacacagccttccagccctcatccccgcttttacagctcctgtttgaaagtgcctctcccattcttttacagccctcattaaacacctcgctttttcctcttatgctgttaaaaaactgtggtgccttcattctttctcctgccagataaaatgcccccttttcaagcaaaagcataaaatcatacagcatcgctatatctgccttttttcttttgctgtaatcgtttatcagccccgataccgcaaacagtactgtacaaaagcctgtaagcttcatcataaatgctatagcgcctcacccctttttcatcatggtctataaacacaaaccgttctatggcatgtggcagaatttttctttgcagatcatctgcattggtgccatgtacactgccaagtatccttattccgcaactcacaagctgatttagtgcctcgatatcgctttctcctcccagctcatccactgcaatcacatccggtgacatagagcgcaaaagcatcctcatgccaagtgacttcggacagttatccagcacatcactggaattgcctatatcgttttgagccactcccaagtagcacgctgctatctccgaacgctcatcaaccaccgacaccttaagagctttttttccgtcacagccatctgaaagtatccttatgcagtctcttaaaaatgttgtttttccttctcccggccgtgatataaccaatgtattgtaaatgctgttttcatctcggatataaggcatcagtggcattgcaacgtcccttatctgatgggcaattctgatatttaaggacgctatctcactgactgctgtaacctttcctccatcgcagcccatctgccctgcaattcccacacgatgacctccctccactgtaaaatagcctgctgcaagctgcggtgctatcgcgtggaatgaatatccgctcagataatttatcatctcctcaatatcgctatgtgagatatacactccggctctacatcctcccgcaaacatatactgcacctgctttccggcgcgcaccctgatttcctccagaccacacggcatgtacgcttctgcctcagccttcatcttttgtggcagataatcaattatatccatatttttcactccttatcgccacttcgatggcaggtcgggatagggctcacgcgtgtggctgcagtgtcgcagaagctacgctgtgctattaagactctgtataaattatgcagtaagtacttctatgcctgacgaaaccgtcgatactcgccgtccgggctcgatatctccttgcctcggcgtccatgcctcggcatttctgtgcttcaaagcataatttaacagactctaaatagctccgctatacgcttctgcgacactgcagccacacgcgtgagccccatcccgacctgccaccgacagttattcaaataaaaaaaggacacagacgattctgataaatcatctatgtcctatttatattacatgtccaattgttttagaacgtgaaaattattattttttacatcctgtcaggagctgagaatccaagcatatcgatacaagcctcaagtatctcctttgtgagcacaagcagcgaaatatatgacttcttaagctcttcattctcctcagaaagaatctttgtgtcatggtagaagccgttgaatgcgttggcaagctcgtagatgtatgcacatatcttgtgtggtgcagactcctcgtatgcactctcaattgtggcattgaactttgccagagagagcatgagattcttctgtcctgcattgactgccggcatgattgcatccttcagtgcgctgatgttgccaccctttgcctcatactttgagaggattgacttgatacgcacgattgtataaaggatatatggacctgtgttaccctcaaaggatgtgaatctgtcgatatcaaagatgtaatccttgctcgcctgattagacaaatcaccatacttgactgctgcaagcgctacagttttggctgtctgctcagcctccgcctcgtctatatttaaattctctttttccttctggttttccttaatcttattgagcatctcatcgtcaatttccttgaggaggtactcaagacgcattactccaccgtctcttgtcttgaaaggcttgccgtccttaccgttcatggttccaaagccgatatgtacaagctctgtagtgtcaggtactatgcctgtctttcttgcacagcggaacacctggataaagtgcattgactgacgtgcgtctgccagataaatcacacggtcagggttgttctccttcatacgcataacaagtgttgcaaggtctgtagtgctgtaaagtgaggctccgtcagactttaggatgatacatggcggaatctcctttgtatctgtatcctccttcacatccacaaccaaagcgccctcactcatatgtgcaaagcccttttccttcatcatttcaaccatctcaggtacatatggctgtgcatccgactcgcccttccacagctcaaaatgaacattcagattctcataatttctcttcagatctgttacagagacattcatgatgtgtgaaagcagtgcctgatagcctctcctgcctccctgaagctcttttgtggcaagaagtgctgcttccttgaagctctcatctgattttgacttgccgctggctgtcggatatatatcctcaagctcagatatggtaaacggtgcctccttcgggtactctcctgtatagctctcatcaaaataaacgagttcaggctttctctcgcgaagctctgtgatgataagtcccatctgaagtccccagtcaccgagatgcacatcaccgatcacattgtgtcccatgaactttgcgatacgcttaacgctctctccgattactgctgagcgaagatgacctacatgaagaggctttgccacgtttggtccgccgtaatccactactatagtgagtggctttttggccttctccaagccgtatctgccctcgtcatccttcatatcgttcatatattttgccagaaaagcggtatccattttgatattaagaaatcccggctttactgattctactgactcaaacatctcatctgactcaaggagcgccgctaccttgtccgagatcataaatggtgcacacttatactcttttgctgctgccattgctccgttgcactggaactcacaaaggtccggtctgtttgaaagtgtaacctttccgtacttctcgtcatatcccgcactgacgaatgcctttgtcacttcctctgatatcaaattaatcagttttttcattgtattcctcctgatatatagctgttttgcgtcaaacagcgaatatacttatattagcacacaaatgaattgctttcaatatcaaccgtcatttttgctttctgagtatatattaaccggcaacgtaaccttgcatttgcacccccaaaggagtatgatttcatatgaaaatttaaaggaggtcttatcaatgaagataaaaaccaaacaaataaccgttactgcaattatgcttgcaatctgtcttgtcagccagttctttaagaacttaagcgtatacatcacagggccggtcatcaatgctgctttaatacttaccgtactctatgccggaatggcatgtggcattatcctaagcattatcacacctgtcacatcattttttatcacaggaagtcctgttatggcagctatccctgcgatgtttccatgtatcatgataggaaatatcattctcgtggtatgtgtgggactgcttcgcaaaaaatgcggcaaagctgccggttttcctgtatcaattgcaataggtgccatactaaaggccgttttcatgggaatagccattgctcttatcattctacctgcatttctgccctctccaatgcacaagatgctgccggtattacagcttcagttttcagtgacacagcttatcaccgctgttatcggaggtgtatatgcagtcataattgcggctgtgcttaaaaaaacttctttagcacaggcagactaaatattcaattatctgcttatgcttccagatatccgtgcatatttttaagcgcatttttctcaagccttgatacctgtgcctgagagatatttatctcctctgccacctctatctgtgtcttgccctcgaaaaaacgcagcttaataatctgtctcgctctgtcatcaagcagctttaaggcatcgtcgagaaccagattttttacccatgcttcctctttgtttttcttgtccgatatctgatccatcacataaagtgtatcaccaccgtcagtatatacaggatcaaagagggaaagcggtgtctggattgcatcaagtgcgtatagtatatcgttttcagggataccgcaatcctttgatatttccgctaaggacggatcatgcaccagctttctcgatagcttttcctttgatttaatagcctgataggctgtatccctgagggaacgtggaatgcggtatgcactgttgtcacgcagataccgtctcacctcaccgataatcatcggaacagcataagtggaaaacttaacacctatagtcggatcaaaattatcaattgatttcataagtccgatgcatcctatctgaaataaatcatccatattttcattatggtttgaaaaccttctgattaccgaaagcaccagccttaaatttccacgaatatatttttctcttgcagccttatctcccttttttattttctcaaacagttcttctttttcatcatccttaagtaccggcagttttgatgtggtcactccacatatatcaaccttatatacagacatgggaatcctccggataaatttctttatctaaagcattcccatttacagtaattttattcaattaatccgcgtatataattctacagcactgccgctatttttatatccttttcatccttaagcaccagcacactgttgtcttcaagcaatgtaactgtaggccttgaatacttctccgtcaaaaaaattattttggcctttttgccgtttgtcaaaagcacagtgcttccgatatatgagcttgcaatcttcttcaaaaacatccctatatacttcggatgatactttgatatgccatcatactcaaaatctgctatcacatcaaacggacacatcccatcacggtaacagcgctttgacgtcattgcatcgtagacatcggctatcgtaataatagctgatatatcatcgattttatctgctgtatatccaaacggatatcctgagccgtcaaacttctcatgatgtaaaagtgccgcacgcttcgtgctttcaagaatcttgaaattattaagtatctcatagccatataccgtgtgcttctttatcacctcaaactcttcctttgtgagctttcccggcttcaataatatctcatccggtatcttaaacttgcctatgtcgtgcaacagacctgccattgaaatctcatccagcttttctgtatcatgccctgcccatacaccaatgagacgtgcaataattgatacattcatggaatgtgccatcgtagatacatctgtctgctttaatacctgaagtgcgtcaaatagctcatatgaagtctcaaacctgtcaaaaatctctaccgagtccctgatgagcgtattcttatccggtatgatattcctgtatagtatgtcattcatatattcatgcaggttatcgatggaatcacggtatttttccttaatgatggcatattttttattccattcttctttttcctgtgctgagcttccctcaatataaaccgaagctatattgtagaatccaaactttgctatatcaaatgccgatacagcctgatgtcttttaaggataagctgtccctttggcgaaaacacatctactgccgtagtcattccctcttttagttcattaacctttatttctctcataatactgtttccctcttgtcatttatcttctcacttgcactcattatatcatgaagctttgcttcatgatcaacattcgtcgttcgccgaatgcataaatgcattcttctcacttgcactcattataccacaatttctctacatgggcactgattttatgtacttcttgacattcaaagcattttttgttaacatagcaaggcgaaaataaatgcgtcagttcgaaaccttcctgacgtaaaacaaaactaaaggagaactaaatatgagaaacaaaaaagtattatttgcagtacaggcagctatgattgcagcactctatgttgtgctcacgtatatcaccaatctgcttggtctcgcatcaggcaccattcaggtacgcttttctgaagcgctttgcatccttccggttttcacaccggcagccattccgggtcttttcatcggatgtctgatttccaatcttatcacaggcggcatcatctgggatatcatcttcggaagtatcgctacactgctcggtgcacttggcacttacttcctcagaaaaaagaagtttgtatacacgcttccacctgtcatcgccaacattattatcgtgccactcgtgctcagatacggatatggtttaacaactatatacaagggtgttgatatctctcttcttttcaatgcagttacagtcggaatcggtgagattatctcaatctgtgtacttggaagcctgttaaagggaatactttcaaaatacagaaatgtcattttcaagcaggacgaggcgtagttacatacatagcacttttaataagctgcgcgtcataaaataaaaaaggggctgtaaaataagtccctaatataagaaacgccaattccggcaaatgtcggttttggcgtttctttgtattaacttttctatttctaagcaagtatgcatctttgggtataaaaaatggtgcatttaataaagctcggctaatcacgtccgcttaagttttatgcagctttcgtctgtcgttgctttttattatgatatttataaagattgaatccacatgaaatcagtgtgagctcgagaattacatttttctcgcctctccggaataatcttttatacgatttgtcccactttaatacaccaaaagttccctccgattgaatacttcggttcattctcaagagagcaccatgtatggattcaagattttgcagcacgatacggattctcatgatactttttgtccgtcgtttcttttttgtacatggtaaatttcatgtatttttccatgccgtgttcttcacaataaagataattattgtaagaaccgtatccggcatcagcaaccggatatttcggatagtgaccatatgtgcgattgaattttccatcaaaggcacaaagcattccatatcggatgcatatggttttacgtcgattacagctatgtattcatcacagatggctgcctgtaggttgtatgccggaagtagctgatcgtttcccatgtaatcacgctttaaacgcatgaaagttgcatcatgatctgttttggaataactgtttctttcttctccacaggtctcgatgtgatatgcataggatttcaaacgttccagatattcatgcaattcttcgtattgtttttgtcgaatgctttttctacgaccacgtccggaaacgaaagaagtttcatccagtccggttgtttctttgtacatcgtaagtaattcagagacataatcaaccgcatacgcttcacgcttttcaaattttattccgagatatccaagtacttcctgattcatagcatcaatcaagagtgaaatcttgtcaaagactttctgccggtttttcacacacgatttttttcatacccaggtatatcgattggcatttgcctcaatttttgtcccgtcaatgtatgtatgctgcagatccacatgatctttggcaaaaatatatgaattaatgtcttcaaatatctgctcgatagaatcggttagttcgtttcggattaagtttccaaatgtagcaaaagaaagagttttcatgccatcaagaagatacatgtaacgaatgtcattacggcagagcttttctatttctcgtaaggagcagatgccattttccataaaggcaaaaagtattattttaaggagtttttgagcatcacatcttgggtgacctgttttatagcctttctctacaaaatatctggataggtcaatgtgatccataacctcacaaaaagtgtataccggatcggaaatatcgatcaatttttcgatttctaatggtaatttcagctgacgcatagtataattaccattggtattattatttagtagcataattaattataccaaaaaatcgcgggtattcaaagttttttagggtctttactttttagggtctttcgttcgggttcttcagtagggtctttcagtagggtctggttttagggtttatcgtgagggtttgaacctatatttataataaaaacagggtatgttagctcgtattacacaagctaatctaccctgtttcttttttgtcctgcctcatttatgattattttgcggaaataaaatttcaaaggaggacaaatgaataatatcacagatttactagaccttgaagactctgatataaagatttcagacattattattgaaggtcaaaccaaaactcttattatcgaaactccacctgttgccagctattgtccaatctgtgggtttcgcatgcactctcgtggtgtaaagaaaaggactattaaccatcccattcttcaggatggttattccttgattctgctactcaaacagcgccgctggcgttgttccaatccagactgtctgtatgaagttaatgaatccttccgctttgtcaacaagggacgtagaactacaaatgcaactgacatgctcattgtagaggcatatcgaaatcttttagaaacatccgcatctatcgctaaaagattccatatgtctgacacatatgtgcacgagatctttgaccgttatgtcaagctggacaggcttcctcttacagatgccatttccattgatgaagttcacctagatatggatgatgactgtaaatacgcattggtcatccaggatttccataccggtgaccccattgacttgcttcgcagccgaagaacttccgtaacggaaccgtactttgtctcaatccctgcaacagaacggaatcaggtaaaataccttatttccgacatgtacaatccttacattgcctatgtagaaaagtacttccccaacgcagtccctgttgttgattcctttcatgtaattcaatggattacacgttctattgacaactacatacggctgcttctaaaaaaatacaggcaacgcgaccgtgaatatcaggacaagctttcctatgagcagcaacgacctgtttcacttccgccatcagacgaagtataccttctgcaaaaatacagatggttaattctgtccaatcagtccaacatccggtaccacagtgaccctcgcatggattctcactttcatgtattaatgaacacctatgattacgaagatgctctctttcgaattgatccaaacttgaaagattttcgagacttaaaagagatgtacgtacaatttaattcacgaaacggcggaaatccactccttgcacggaatgaattaaaagaattgattcagacatacaaaagctcccggtttgaaatatttcgtgactttgcatctttattgaaaaaatttgaagaccctattgttaattcatttattatggtcgaaaaaatcgggaacggcaaaatttatgatgcacgtttatctaatggtcccatcgaatccattaaccgcaaagtaaaagatttaaagcgactgggcagaggcttccgcaactttgagcactttcgcaacagatttctttttgcaactagacaaacaccggtgcttaatggaatcactgattataaccctgtaacttattatgaagaaaatgatttttaggaggaaaccacatggaaaactactgtgcatttagtaaaaaccacacttgccttaaatggcttgactacataataacacgtcaagaactagaggaagcagactctctctgtcacggaaactggatagagattcaacacaagaaccaatacattcagaccctacaggagattctggacagcaatcacatctcataccccgatgaaatatagtttaatttaataaaaggtctggctacccagccagaccctcataaaagaccctcacgaaagaccctaaaaccagaccctatcgaagaaccctaaaaaactatgctttttttaaggccagaccctatcgacaaaccctaaaatagattggcaaaccctaaagaactttgattatccaaaatcgctcagacctcacggtctgggcgattttctgtcaggggattttttttacagccccttttgttttttaccagacctaatgcagctgtcagttaatttttgtaagttattcctccctaaatttccatagcatctaccattatacttatttctctcttgcctgtatcctgatttgcatttgccacaaactcataaaccggacgataatatcccttcgaatccggtgtgtaacttatcttcactgattttacaactaaatcagataattgttcatctttatcataatccgggaaataaaattttcctgcacatagcctgtcataagcctctttttctgaaataacatctacctttttataaggcgtatattttatcatggagtctctgaaatttgcaattttacctgacgaattaatacaacattctatcgttcccttataatacaagccatcgtcaagaatttctccatcgtttgtaaacctatagtttcctgcatcatattcctcgattggtgcaaaaactgcgttttcgggaataaccactcctagattttccagcttttctctgacaaattcctctgaaagtccagcgtcagcatacgaattttcatcatctatatttgaaaaatccgtgaaacttactgttggtccttcgtaatcgcaccagatactcaggttactgccctcatcatcaaggctggtactgtaaaaaataatagtatcatcatatatgtctgtttttgagtcatctattaaaacaccatactttgaaaagtacccgtcggcaagctccctcgcctcatcttctgtagccctgtgaattgtgtatacatcaagcggatctgcctcatctgccagactcacaccatctgccatcgagacatccacattttgatttgaaatattatcgattgaaagattaccatattccatactattgtatacaataaaaacagctgcaaaagctataattgtaaacgcaagcggaagctgtgccaccagacattttcttatggaaatgttctgtctttcacaaacattttcatcatgtgccactccactgacttcatttgtattatcttggactttcttccttgaacagactgccacaaatatcagtcttgcaaccgaaaataatccatatccgatcattgcacctatcgtattatttatgatatcgtcagtttcaaatacacctcgtcccgtgataagctgcacaacctctataaacagtgcaaacccaaacccgcacaaatatattttccacgctcttttaatctttccaaaacaaattggtagtaaaaatccaaacggcacgaacatacatatattaagtatcagatttctccattcctgtgcactaaaattgtaccaggcctctttgtacgaagaaaatggtttaaagttagcccggtactcaaatcccccaaaaccaatacctcctcttagcaatgtcacataaaggacaacaacaatgtatactgcaagtacacacaccagtcctattctgccaattgaaatctgttttttaccatgcaatatttttttataaatcattttgtagcctaaaagccagattattgccaaaaaagccactacaatagtggcaaaaataatggcagactttcctaatctcataatatctgatattctcattacattctcctcatacactgcattttattcatctatatacaaattttaaagctgcgtgtctccgttaaaagtttattattctacgtctttaaccacttgctgcctgatgaatatatacgtttctaaaaaatctttataaaaatggtaccatatacattggaatataataaattccgttttcccatttgtaatcttttgtatgaacaacatatttgctacctatacgattactaaacttgttgcaaaatgcatcaagtgatttatgcgttctataattaccggatttcacctctaatggacatatcttatctttaacagaagttaaaaaatcaatctcatacaaatgatttgaagtttcacctttcatcgtgtaataaaacaaattattaccttttgctattagcatctgtgccacaacattttcatagacatatcctaaatttacatctagtttgtccgaaagtaacttattataaataatattctccgtatattttttatccttaaatgccaaagttataaataaaccaacatccgaattaaacaatttatatcgtcctgcatccttttccaacgacattcctacatcaggattattagcgtgatatgcaatatttacggtgtacgaactgagcatatcaggaatcagttttcttactttctcagagcgaatcccctctcttgcacttgacagaatatatcttgatgcattaccactaaggttagcaggtatggcatcataaatatcaccagcaagaccagttccatctatcttcacaaagtcttcttcatataaatctacaatttctcttttagtttcatcaaccaattgcaaattgtttttctctatatacgtttctatgaactgtggcattccaccaacaagcatatacaatctgaatgtccgcatcaggtttctatgcattgcattccctgcagcctttttattctttataagataccttattgtttccgctgatacctcatctcctattgcccataagaactcctcaaaatccataggaaacatagatattttatgttcttcgcttggaatcaaaatatcctttgtattcttttttattgataataaagagcctgtttcaatatacttatatcttccatccgaaacgagatatttaattgcctgcctagcctttggaaataactgaacctcatcaaaaataattactgactctttctcatataacctggttcccattaactgctgcaattgcaaaaagaaaaaatccagatcatacatatcatcaaatagatcaataattgccttacttgtatgagcaaagtcaatgagaatatacgatttaaactcttttttacaaattcctctgcaatagttgatttaccaactcgtcttgctccctttatcaagagtgcctatttatcgcttctgttctctttccactcatatatttcatcgtatatttttcttttaaaaactggtttatccatgcataaattcacctttccgccacaattataacacaaatcccctttcatgtaaatctgaattatagtcaaatccctattaccaaatccctattagttttctcgcgtttttaacgcatatccccctttgattttcctggctattaaatttacatctatttcttcatcttctcattatgtacatatatcacagttcttacacaaaaatagtatcacatatttttattaaagtatcctgtctcttcccacaccttcttatctggacaataataactatattctcttgaatttccaactttcattgctgttccaaattttaatattccttgttgtatgccaattcttatatattatgcatcctttccaattgctttagcaatctctgcgataggcacatttctatgtgttacctgttagttaccggaacattttcgtgtgttttgaaggtgtctgatagattttcagaatataaagaaaaccccgaaaatacaggattttcggggtctgttgctctttttcgatattcggttgaattatctctttgttaacgttttgatatcctaaaaagcccataaataggggatttgtgtgtcccagtgttgcatatatgttgtatgcgattgactgcccacacattccctttttgctttattactttgatatgctgtgattacattctatctatcccacttatcacacagcgcatttatctggtctgcaaacttgctcaagtccttattagccataccctgacacttctggataacagatacaagcctctggcctgctgccacaagacggtcaaatatagtcttctctctgcttgccatgccatatgcagcctttttctccacaagcttgcgggagccatctgccaccttctgattcgtgataaggtcatatgcatcaccactgtatggtgccactgcatcatagccgaaggtctcatgcacgtggtttgcaaaggactctgctgtggactcctctccatggactataaatacatgctccggcttgttttttattgcgccaagccactcggtaagctgatttttgtctgcatgtccactgatacccggtagatttactatgcttgcccttacttctatttcctcaccaaaaagcttcacctttttagcaccgttcaaaagtgcatagccaagtgttcccggaacctgatatcctacaaacaaaactgttgaatcacttctccaaagattatgctttaagtggtgtctgatacgtccggcctcacacatacccgatgctgagatgataacctttggcttcttatcgaaattaatcatctttgactcatccgatgatactgccacacgaagtccggggaacttgattggattgatgcctgccgaaataagctccatagcctcctcatcaaagcagtccgatacattctcatgaaatacatttgtcgcctcaacagcaagggggctatcgatgtaaacctcaaaattcggatgctccggcagcagattctcagtctttatacgcctgataaagtagagcatctcctgtgtcctgcccactgaaaatgccgggattaccagatttccgcctcttgtaaatgtcgcattgatgacctttgaaagctccaccgcgtaatcaggcggcgtatcatgcagacgattgccatatgtagattccataaccacataatcagcactgtccacatactgcggatccttgatgagcggcctgttgtgatttccgatatcacctgaaaagacaatctttttggtcacattctcctcagtcacccacatctcaatggatgatgaaccaagcagatgacctgcatccacaaatctcaccttaagccccgggcatatctcatacacactgttgtaatcacacggtgtaaagtgctgcatgacattctgtgcatcctccacattgtacataggagtcacttccggtcttccggctcgtcttgcctttctgttcttccactccgcctcaaattcctgaatatgtgcagaatcctttagcatgatgttacataaatctgttgtcgcctttgtcgcaaaaatggtgcccctgaaaccatgattgtatatgagtggcaaaagacctgagtggtcaatgtgtgcgtgtgtgacaaacacatagtctatgagtgaaggattgaccggtatctcctgattcacgtacaaatcagctccctgctccattccacagtcaataagtatatgtgtgtccccaaatgtcagatagtgacagcttccagtaacctctctgtcagcaccgataaattccaataccatactaccatctcctattctgttttataataaaaatattatatcacacttatgccattttctgtatttctttcttcaatctttccattatttttttttcgagccttgatatgtatgactgtgaaattcccagaatatctgctacctccttctgcgtcagctccttattctccacacggtttactccaaatcgaagctctattatctgtctttcacgctcgttcaatgacagcatggctttttttagcagtgaaatctcaacctcagtctcaagatccttatatatgacatcctcatccgtccccagtatatctgataaaagcagctcatttccgtcccaatccgtgtttagtggctcatcaaaagatacctcaagcttcactctgttgttgcggcgcagatacataagaatctcattttctatgcatctggatgcgtatgtggcaagctttattttcttctcaggattgaatgtgtttatcccctttatgagaccaattgtgccaattgatataaggtcctccacgcatactcccgtgttttcaaatttttttgccagatacaccacaagccttagattgtgctctataagctgcttttttgcctgttcctttgacattgccacatttttatccaccaatgcaatcagacagcacttctcctcatctgtctcaagcggaggcggcaacacctccgtccctcctatgtaaaacacctcatttgtgtgcggcttgcttccccagagtattttccatacccgttttattactaaaaacagcttcattcaaaatcatatcatatgcattgtcctcaaataaactatccgatgctcttcccaccagcacattatgtaaaatcagcttaccatttcccttcatgactgtcatctcatcaaattcacacactttaatgcttccaccatcatttcccagactcttgtacggcacatcaaaaaagacggcatcttctcctacaatatcaaacaatgcactcccgcctatgtgcaccggaatctgctgtggctgtttttttagcagatttcccgtatcatacaaggctgtggcacaagctcttttaccatcctttaaaagtgtgaccctatatagtcttctgctctcattacttcgctcacagaagcactttaacactatgtatgatatgacaaaaccaaagcatatcataactgtcgcatcagagctgaaaaagctgtctaacgctgttactatgcctccggtcagcactgttacaaacatacatagtgcaaaaagccttagaaacggaatttttctgccagcctgtctgcctattgcaagccttgccgcaagcggtacgaccaccagaacagaggtccatttataaaacgcatagctgcctgccaaaagaagcagtacacattcacataccgatgcaccaaccgcagaagcaatcagacgtaccaccgtcccgatcaatgggatttttagcatatatatgacaaatataagtatgagacaattggtgataaatgtacgaagaagaaaaatatcgagataaaatgcatagataatttttcacctcactttcacagacaagaatagcgtaaaagcaggtttttaagtgccgtaatatgtcgacaataagcaaaaaagacatgcagcccaaaagctgcatgtcctataaactatcgtcttgaattcttaaggaaatccggaatattaatctctacaggcttaaccgtgctctcaggctggcgtggcttctggatacctgtatatgcatgtgcaggtgctgtctgctgtggctgggcagctgtatgaagtccgcttgttgctgttgagtgaagtcctgctgttgctgcggattgtgttcccatgcctgaaacaggtcttgctgctgtctgattcggatataccatacggttttgcataccgcctgccattcctgcaccaggcgctgcctgcttgcccggcatatctatcttctctgaaacatcctccagtcctgtagcaataacagtgatagaagcctgatcagtcatgctctcatcaaacttggcaccaaagataatattggcattctctcctgccagatcctgtacgtagcttgctgcatcgtttgcatccataagagagatatctcctgagatattgataatgacatgtgttgcaccatttatctttgtctcaagaagaggtgaagcaaccgcaagcttaacagcttcgatagccttatcatccccctgtgcactaccgataccgatatgtgccatacccttgtccttcatgacagtctgtacatctgcgaagtcaaggttgataagtgcaggaagattaataagatcagtgattccctgaactgcctgctgcaatacctcatctgccttcttgagtgcatccggcattgttgtgcgacggtctactatctcgagaagcttatcatttggaatgacaataagtgtatcaacgctctccttaagtctctctattcctgaaaccgcattaatcattcgctgctttgcctcaaatttgaatggctttgtaacaacaccaactgtaagtataccctgatcctttgctatctttgcaacaacaggagctgcacctgtaccggttccgcctcccataccgcatgtgacgaataccatatcagcgccctttactgctgcctgaagctcctctgcgctctcctcagcggccttctgaccgatctcaggctgcgcacctgcgccgagtccctttgtaagcttctctccaatctgtataagtgtaggagccttacaaagctgtaaagcctgcttatctgtattgataccgataaactctactccaccaatattctcatcaatcattctgttaactgcattgttaccggctcctccgactccaatgacaataatctttgcgctgttatcagcctcgttagttcttatctcaagcaaggtgattcctcctctttctttcccaaaatttaattttctatataaaaatatcgaatattcttaaactcatttattctataatataatttttctccaaaataatcaactataaaatatgattttttttatttagttttacattattctgacttgtcaaacacaatatttgttgtttcttccgtccagctctctaaatgtagtgtaccggactgtccctcaagcgatggcatgatagccttaagcctctctattttacgtgtaagctttgtagtgtcaccaattatcacactcacattaccatacttgactactggtgcattttgcgcaccataatccacagaatccggcacaaggtcctgcctttttaatccctgtgtaagctcaaggatatcttttagcatagtctgctttataggaagcttctcgtaaagcactaccttgtcacagcttatgccgtctatacatggcacacccggcaccgtgtcagaggatgtttccaccacaaagccatccttatcaaaatatgcattctcattaattcccggaatatatatgtatccaagcattcctttttcataaactgatatatgaagagtatgcggactattcaggcttatgctcattgtatcaataaacggtatttttttagtatcctttaccttatatttcagatagacatacagtgagttccatgaatacttatcattaagcaccgcatcctctatagtcttttggtcgtaaagctcattgccctcgacaactaccctttttaccgtaaacagcttaagtgcaatgagaaacagtatcgcgagcactgctatcgtaattagcagtcccataaaaaaatgctttaatctctttttatgttttctttttttcttaatcattatatttcacgccttaatctacacattttcaagcctgatgcctcttgacacagacaaaacaagccctatttccgccatcaggaatatgattgacgtacctccatagctgataaacggcagaataacaccggtatttggaagtgaattggtaactaccgcaatattcagtatcacctgtattgcaatatgactcatcacaccaatcactaaaagtgagccatacaaatcccttgcattgtttgcaatgaccatcatacgccatataagcagtataaaaagtaaaataaggcagatagctccaaacagtccaagctcttcacaaataattgtaaatatcatatcattttgtgactccggcacattgccaagcttctgtaaactctctccaagtccttttccaaacaatccgcccgagcctatcgcataaagtcccatcatagtctggaatactgcgtctgttcccgcagtctccggatgcagccatgcctcaatacgtgtacttctatagcctgccagcatgacaaacgccactgcaaacacaactaccgccactgctacaataataaactgcagatactttgggcttgcgacaaacaacatacagaccgaaatgcctatgatgataactgccgtactcagattgctgattgcaacaactattatgagcggaataagcatagcaagcacctttaccagacttaaaaacttatcaaactgcttgggtatcttgtctataatcatagccataaacagtatgaccgcaattttagccacttctgaaggctggaactgtattggtcctatgccaatccatctcgatgaaccatgtgagcttgagcctattttcggcacaaacacaagcacacacagtataagcgatactatatacgcaaaaaagccaagctttttccaatatctgtagtcgacctttgccagaaataccataggtataagtcccagtacaatatttcgtatctgaagcttaagatagtgcatgctgtcatgatttttgatagccgatgtgtatgcactcgagctatatagcataacaagaccaaagcagagcagaaatataactataaacaacaggttgtagtcgaaataaggtattcctttttcttttttttctttattcttgctacttcttctacgctttcctgccaaaatatttactccttaaatccttttactatttccttaaagatacgtccgcgctcctcatagttaggaaacatgccccagcttgcacatgcaggtgataaaagcactgcatcacctgaaacagcatgctcatagcaataatttactgcatcctcaaacgtatccttctttacagtattcatgaatccgtgtctgtgtgcacactcttcgattttatctgcagtctgaccgataagcacaagctcctttactttgccgtcaaaggcctctatccactcatcatactccgactgcttatcatatccaccgccaatgagaagtgtcggtctgttcatggcacgtataccctgaatggctgcatcaggattggtgccctttgaatcgttgtagaatctgactccacgcttttcggtcacgtactctatcctgtgctcaactgccttaaataccttaagaacctcaactatcttatccatcggtaccccaaagcttatagacatggcacacgctgccatcacattctcaaaattatgctttccgaggagattcagctcgtttacatcaattacctcatcgcgtacaccgtcgtgtgcgtatatgatgatgtctccgtccagataaaagccctctgaaagctcagacctactgctgaaaaatataaccttagccgggcactctgctgcaaaatctctaagcacctcgtcctcgtagtttaacacgcagtaatcatctgctgtctgattttttgtgatgtcctcctttgccctgatgtaattttccatagtatggtgtcgattcaggtgatcgggtgtgatatttaaaattgcgcttacatgtggcttaaaggtatctattgtctcgagctggaagcttgatatctctgcaaccgttactgtctcacctgtgcttcctgtgaccattgatgtataagggattccgatatttcctaccactctcacatccttaaagtaattcttcattatctcacctgtcagagctgtagtggtcgtctttccgttagttcctgtgatagcgatgatctcacctgccccaaatgtgtatgcaagctctatctcaccccatattttaacgcccctgtcacgtaaggcattgaccataggaatgtctgttggtactcccggacttagcacagccacatcaaactcatcaatctgttcatctgtcaggtcgcctaaaataagcggcacctccttaagctttggtgctttctcataaagtgtttttgaatccagttctttatttccatcaaacaatactgtatcgatgccatttgcgcacaaaagttcagtcgctgcaatgccactctttccagttccgacaacaagtaccttttttccttgtaagctcatttttattcctccatcttttattgcagccatccgtatggatatgtttaacaaatcaaattctccaaacgactgccttaatcattaaattatagtatacgttatttggttctatttcgcaagagcccgtaaatcagttaaacactcctatctcctgtgcatacggtatgatttccctaaatatttcagctgcaaccggtgcagcgattgttccgccatagtatgcaccgccctttgcattatttattttcacaagcaccataagtgccggatcatccaccggataaaacccaaggaacgaggctatatatacattgtcacttctcggaagtgtctgcgatgtagcagtctttcctcctatcgcataaccttcaacctttgcattttttcctgagccctctgctaccacgccctccaaaagctttcgcagtgtatcagatgtctcttcactgcatatacctgacgtctgttcaaaggacagcacctcctttaccgtaccttcggtgccatgaatctccttacctatatgaggagtaattctgttaccaccatttataagcgatgatactgttgtcataagctcgatgggtgtgagctggaatgactgtccaaatgaaattgttgcaagctccacctggcctatcttatccggctgatgcattatggtggcggcctctcccggcaaatcaatacctgtcttatcaagcagaccaaacctcatgaaatcagcataatacctctcactgcctattctaagacctagatcaataaagaccggattgcatgaattctgtattccctgcacaaaggtctcacttccatgtcctgttctcttatggcagtgtatgcgtctgtcctccacagtaatatatcccgggcagtaaaaactgtcatcaaggctcaccacatcctcctccagtgcgattcctgccgtaattatcttgaatactgaaccgggctcatatgtatcacttacacagccgtttctccaggcttcatcatggttttcacatgaaaaaggatcattcaaattatattccgggtagtcggtcatggcatatatttctccgtttttagggtttaaggcaattatactcacactgtctgccaggttttgtgcatatgccatcattgcatttttctcacatactctttgtatatttatgtcgagtgtagtgacaagtgtgtctcctttttggggagcttctcttctctccttataacccttcacctccacacctctgccatcacatacagtgtatatccgccctggtgtaccacgcagaatttcatcatatgtagtctcaagcccaacaacaccctgaccatctgctcctgcaaagcctataacctttgaaaacagttcatcaagcggatagtacctgacacttgactcgtcaacctttatccctgccaagccatatgatagtattttatcgcctgtttttttagagacattattctttattttttcaatggatgtaaccttatccaccttactgcggatagtcttttcgtcaatcgaaagctcactgcttaaaacagagatgactgcttccttgtcggttatctgattgtgtataacgcttatgttatatgccgtttcatttgtcgctattatcctttcatttctatccactatatctccgcgtatccctgcaatatcacgctctctttcctgaagcgcgcttgcctttttactgtaataaccgccttttactatcatgagataaaacagtctgaaacacaaggcgataagaacagctgtcagtatactgcaaaatacgcatatttttcttctgtagcgcgtattgttaagtatcatgaacaaaaatgcctcaatatttttacactaatatatgcaaaaaatattgaggctattctctattcgccctgctcaccctcctgggtgaccttttctcctgtcggaggatttgcgcctgttatcgtaaggtcagcatttacaccggtctgctcctcatcagggtatatattcatatacggaagtacttcctttaatatctctctggtcaggttctgtgcatagttactgtgaggctgatcctgtacattcggctggtcgattacagtgtaaataacaagctgcggatcctgcgcaggcacacagcctataaatgatacaagatagcagcccctctttctaaggtgcgttgtctcatcatacatctgcgctgttcctgtcttgcctcccattgagtatccgtcaacctttgccaccttaccggttccgtttgcaactacattctgcaggtagtttttaagtgtcgcacttgtattctctgacactgtcttttttagcagtgtaggctcaattgtctttactgtattgccgttgtcatctgcgattttccttactacgtgcggctgataataatttccgccattcaccagtgaggaaaatgcactgaccatctctatcatggtacagttatagttctgtccgaatacgtttgtcgctaaatcgacaggctttatattgtcgagtgtatacatgagcgttgatgtatttgcctcacccggcaggtcaatacctgtcttttgaccaaagccaaatacactctgatagtacagaaaattttctgcaccaatcttatatgacatctgcatgagtgcatcattacatgaatccatgagtgccttttcaagtgtctctatgccatgtccgctacggttgacgcatgataccttttcactgccaaacatctcgtatccatcacataaaaatgtcatatcagtagtgagcgtgcctgtatccagtccacatgccacggtaaaaggcttctgtacggaccccggctcatatgtatgtgtaacacagaagttctgccacagcttattcagagtatttaatgtatcatcatcactcattgcattaagctgctcttgtgtatagtaatccttcatattcttcggatcgttcagatcaaagtttggataattcgccatggccagtatctcaccatttttaggattttctataacaactgcaatattttctgcgccaagtccttctcttgcattatttgcataagtatctgagaacagttttatcttatcctcaacaatcgactggatatttgcgtctatagttgtgtacagggtatttccgttttgtgcagcaattactgttttctggaaatcattgtctgcattcagatagccgtactccctaccatttacaccatttaaagtgtcattgtaatagttttcaagtccggttgtacctacatttccggcggaggtaaagccgataactgagcttgccagtgttttaaacggataatttctctgatactctgtctcaaaccacacacccttgatgtttggattcttcagattgcccttttcgtctgttgcatcctgcagctgtacaaatggctgaattgcatcatatgacagcttttttaacagtacaatatatttgttatccttgctgttatttgcataatcctcaagtgttgccctgtctaaatccggaaagcactgtgtcagtgcatctatcgtcggagttatatactctttcttactggtcataaccgagcaatcaagtacgacattataaacagccacactcgtagcaagcactgtgccgtttgaatccacaatatttcctctctgaaacggtattgttttgctgtcatatgactgtaatgatagtacctttttagtatatgcgtctccgcttgtatattcaataaacatcagcctgccaatgagtccaagcatggctacaactattaacataaacaacgcaaacagctttgttttcattttgcgtccgatttttcttaccggtctttttcttgtcctggctgccaatattattcctccaatttattccggaatatcattgtactgatccatatagttgttcttatcaattgagtaataaactatctgatcctgtgaagcatatttcatgccaagtctgttgatagctgcatccttgattgcatttaaatcgacagatgtagtaatctgcttgtatctggcatcattatcagccttcatatcatttatccggctctcaagtgctgcaacctcattcatctgctgtgtcacatttgaccttatctgaataagtgaaacagatacaaaggctgaagctgccacacaagctgtgagaaaggctacaaatgccctgttcattgagagtgctctctcctgatttcttcttgcagattttcttctgtttttctttcttcttatttcctcaagctctcttgtcgatttctgtggtcttctgaccggtgctgcctcgtcaagctctcttactgcgttcccatttatataataagtagttttattcatttaactgctccttttgctgtcattctacaattcattcttttcaaacacacgaagctttgcactcttcgagcgtgaattctcttcaagttccttttctgacggaaggataggctttctggtgataaccgttcccttcgatttattaccgcatacacataccggaaaactcggtggacatgtacatggattttcgttttttttgaaattggattttactattctatcctcaagcgagtggaatgtgattatacatatcctgccgcccggattaagtaaatctatcatgtcatccaggttgtcccttagcacatcaagctcatgattcagctcaattctgatagcctgatatgttctctttgacgggtgaccaccggtagctctgaccttttttggtatcgctgcctttattatctcgttaagctctcctgttgtcgttatctcttgcttttgtcttgctgctgcaatgtgctttgcaatattctttgcaaacttgtcctcaccgtaatccctgatgatacggtacaggtcattttcgctgtaggtatttactatatcccttgcagtaagggcattcctgtcatccatacgcatatcaagcggtgcatcctcactcctgtaggtaaagcctctcttcggtgtatcaagctggaaggatgacactccaagatccagcataataccatccaccttttcaattccgagtgaatgaagcacattcttcatatcagaataattgctcctgactatcgttaccctgtctccaaactccgcaagtctctctcctgccgcctttatggcatctgcatcctgatctatgcctatcagcctgcccttgcccgaaagtctcttggctatctcatatgagtgcccggctcctccgagagtaccatccacatatatcccgtcaggacggatgtttaaattttcaattgtctcgtcccttaagactgaataatgcttaaattccatgtggtctctccatttaatatcaaatgcctatgccaagctctgccatatgatcggctatctcatccatatcgtcaaaatcagagttttcaaggtatctgtctttgctccagatttctactctgctgtatactccgacagatacaacttccttatctatacctgcgtattctcttaagttcgccggtaagaggattctgccctgcttgtccatctcacaggtggctgctcctgcaaagaagaacctcataaattttcttgcttctcttgatgtgagtggtttgtcgcgaagattttcctcaatgcgatgccattcttcgttggaatagacgaacagacagccatctaagcccttggtaactacgaactcattgccaagctgttcacggaacttcgccgggacaatcatacggcccttggcgtctattgaatgattatattcgcccatgaacatggcagccatcctccttttcctcattttgaagttttccaccacttcactccacttatatggtatttcactccacttttcaccacttggttacaatattacacctaacagcccacaaaatcaaggctttaagccaaattcccataaaaaggcaacaaaaaagacgctcagtcttttcgttgactttgcgccttttttatataatgatatgaaatttactctttagtggtggattgtggtggagtgtccaccattttgcccattttcctctgcttatatctgacaattcctatccatatggctgatactgccaccaaagtggcggcgagtgccatagacaccggataattgatatgcgggatgagaagctggtctgtacgcaggctttctatccagaatcttccgacaccatagcctagcaaatatagaagaaacacctctccgtcaaaccttctgtgcttaaaataaagcatcaacaaaataaataagcacaagttccaaaaggattcatacaaaaaagtaggatgcaccgagatatactccactccgtctaccacagttgtatgtgacataagcttttcagtcagatccgatattctgacagctgataccggaagctgcatggcaaaaagtccgtcataataatcgccaaatgcctccctgttgcagaagtttccccatcggccaatcacctgtcccagtatcagtccaagccccgccgtatcacacaacagtggaaacgacagccttctgacctttgcaaaaacgaatgtggtgataattgctgctatcacgcctccgtaaattgccagtcctccctgcctgatattgaatatgctaagcaggtcatccttgtacaaatcccacctgaataccacatagtatattcttgcgcctatcaccgagcatatgattgccacaagtgccagatcaaagtatgtatcaggattttgtcctgattttttggccacatagcaggccacgcccagccccgcaagcataccacatgcgattattatgccgtacatcgcaatatcaaagcttcctattgatatgctctttatcacatgctgcagatatatatgaagatgtgggaagtttatattataatccatatttttcctttcctgactgtaattgctgtctatcacactgtaatatatacggcagcaatcacaaattacgaaaatatatgtacccggagcaccataaacctgatactccgggcaactgtcattatgcgcttcttagtctacgcctgacactcaaagcttgcacactctgtactgcacttgtttggtgtacagtttttcttgatgccaatctgattggccatgcagctattgtggtcattgtacttacactttgctgcatcacagtgcacatctgtctccttgtgaatagctaactctgcagatacctcacagtcacaggccttatttgaaaagctgccacactgtgtatcgcaggctttctttgccttagttcctttcacatcgatttctctgagcttacagcagttatctgcattatacgcacatttttcaacattacaatcaagtcttgtcatacttttgcctcctttgcttatgcataggctagtatgtcctgattgattttttttatactttttaatcgattatctgtgtttttcctcttccggaagctccactctgatttcctttgtacggatttccttgcaaatctggtcgatgaaatctgaaagtggcttaacgccctcatttccttcaaaacggcttcttaccgatactgtgccgtctgcctcctcgtcagctccgacaacaagcatatatggaagcttatccatacgagcctctctgatcttgtatccgatcttctcagctctgttgtcaactgtcacatcgacatcattgcgcttaagctcatctgctacctttttagcataatcagcatacttctctgagataggaagcactctaacctgctcagggcagagccatgtagggaacttgcctgcgtagtgctcgataagccatgcaagtgtacgctcatagcagccgagtgatgtacggtggatgatgtatggacggatcttatcgccgttttgatcaatatagtacagatcaaaattctcagcaatagcacagtcgagctgtattgttaccatggtatcctctttaccgtatacgttcttggcctggatatcaatctttggtccgtagaatgcagcctcgccgtcggcctcaacaaaaggaacattttcctcaataaggatgttacgaagaacctcctgtgttgagttccagtactcatcatctcctaaatacttttctgtgttctttggatcccattttgaaagacggtatgtcacatcattctcgagtcccagcaccttaaggacatatctgttaagattgaagcatgccttgagctcctcctcacactggtcaggacggataacattgtgaccctctgagatagtaaactgtctgacacgtgtcaatccgtgcatctctcccgaatcctcgtttctaaacaatgtggaagtctcacccattctgtaaggcagatctctgtatgagtgctgctttgccttgtatacataatactggaacggacatgtcatcggacgaagtgccataacctcttcctcgccgtccttctcaggatctccgagaacaaacatgccgtcaagataatgatcccagtgtcctgaaatcttgtacagatctgattttgccatgagtggtgtctttgtacgcacatagccccactccttatcctcgaggtcctcaatccatctctgcagcttcataatcatctttgtaccctttggcatcataagcgggagtccctgtccgattacatctactgttgtgaaaagctccatctcacggccaagcttattgtgatcacgcttcttagcctcctccattctctcaagatgtgcctttaaatcctcttttttattgtaggctgttccgtagatacgatggagtcttgccttgtttgaatctcctctccagtatgccattgatgacgatgtgagcttgaaggcttttactccctttgtgctcataagatgtggtcctgcacataaatctacaaagccaccctggtcatagaacgaaatctcctcaccctccggaagctcctcgataagctctaccttgtacggctcatccttttccttcatgaatttgattgcctcctctctagggagtgtaaatcttgttatctcatgaccctgtttgatgattttcttcatctctgcctcaagtgcatcgagatcctctcttgagaatggctgtgaatcgaaatcatagtagaaaccatcgtcaattgccggtccgattgtgatttttgcatccgggaacagattctttactgcctgtgccagcacgtgtgatgctgtatgtctgatgacacgaagtccttcctcatcacttgctgtgattatattgagtgtgcagtccttgtcaagaactgttcttaagtcaacaatttctccgtcaacctctcctgcgcaggctactcttgcaagtccctcgcttatatcttttgcgatttcatatacgctttttgcttcactgtactcttttgatgagccatccttcaatgttatcttcatggttatctctcctttatttttaatataaaaaatccccgacaccgcattgctgcgacatcggggacgataagctttgttaccgtggttccacccacattctttccgcctggaaacatactgtttgtctgtatccgacagaaactcatttgactataacggtgtcaccgggctttattggagccactccaagctggtgttcggtatatcatccaccggggagctttcaccactctttggactttgattctcgtcttccaaggcttccctctctgctgcttttaatatacttactgtgctcttcaacgtattgttattatgctaatgttcctttcaaaaaatgataatatacttatttttctaatctgtaaagtactttatgcattttttccgcaacattttttatatttcttgcccgaaccgcatggacatgggtcatttctgccgattttcttacctactaccactgttcctgacttcttctgctcgaggtaaagcgcatgctttgtctctgcgtcaaagatttcatcccatgccgggagattgtaaagccagtctgcctttgcatctaccatgttcttatagagcttttctttatcgaaagcaaggcttacctttgtgtcctcatccatctcctcgattgggtttggtgtgacaaggctgtcattaattccgtctaagaagcctgtcatctccatgattgataactcatatttctcagcaagctctttgactgttccctctactgcctcatccggatttgcaaggagcttctcatatacacccttctccaagaggaaataatgctgccaaaaacgctgtaactctccctgatctgctttgtcattgtaggcaatcttgtgccactcttctaataaagccatttttactaccacctttatcttttataaactgatatgaggccaaacagcctcaacttcacatatggatgtattataccaaaataacagcttgacgtcaattttgtttttttatattataattattaaataactattcaaaaaccacggagaacaattcatgaaaaagacaaaacgtattctggcactgatcggtgccatccttttattacttttatatgttgtggcatttgttgccaccgtgctcgatcacacgagtgacatgcgctactggaaggctgccgttgccgcaactatcattatcccagtgcttatctgggcgtattcatttgtatacagacttttaaagggttctgatgataaagaatctgatgatgtaaccaaaaaaccatgaaacgcaaaatcacacctgaattatcatctaaagactggaaagaattctgcagccggtttcattttgataacgataagctgccgcttatccgggcaatatacaccgcaatgcttccattggtggatgcctttgcatattattccataaaacaggatttgcccggggtatcactggcacactatgcctacggtctcgtaacactcggaaacggtgcagacgagctgtcagagctgtatttaaaccatgagcagcttgaggaggcctacatagcagactgtttaagcctcatgcttttgtcaaacgcatatgagcagtttgcaaaggctgtcgaagaagaaagctctctttatgccattgaactgtcatttttaggcgatgaatatccgctcgagctgctgcctgagatttttgagcacgtaagccctgatggtatacatctcaccggttcaaatatgctcatgccacttaagacagccgccctcataataaagcttgactcacaaaagcagaaaaatatcaaagagctctgtaatacctgcgcgaactgtaaaaatctgtcgtgcccatcaagaaagggccctggtcctaagctgccacacacctatggtgccatgcagatttttaatatcagacattgaagcccttctttttctcatatgagcctctcagtttctcaaccagaagtgtcagattcctaaacagtgactcagccgcaaagccaaacactatcatgagaagaatacatatatttgacaaatctgtcagtgcaaacagtttctttaagaagaaacccgaaaataccagacctgctatatttccgataataacagcatatttcattccatttagcggctcactgattttaaagagaatcataaagcccactactgaaagtacaagcgtcgctatcgttcctatgcttgcatctgatatacaaaatacttctccgcatacgacaagcgctccgacagctattacatccgtaagtccacccggcagtgcctttagcatgacattggtgataaagtgtccctttatcctgtccttattctgctccagtgccaataagaatcccggtactcctatggtaaacatactgatgagcgatacctgtgccggctcaagcggatacgtaaccataaggataaccgaaaacagtgaaagtaacagtgaaaatatatttttcacaagaaacaggcttgctgagcgctggatattgtttaccaccctgcggccctcatacaccacatccggcatgtgtgcaaagtcagagtccaaaaggacaacctgggctgcctgggctgccgcctcacttcccgatgccatagccacactgcagtcggcatccttcatggcaagtatatcgttgactccgtctcctgtcatcgcaaccgtatgctcttttgcctgtaaagcctttacaagctgttttttctgctttggtgtcacacgtccgaatacagtatatttattcactgcatcggctattttatcctcagtatcgagtgttgccgcatcaacaaagctttctgcactttctattcctgcctgtatggcaatccttgaaacagtacgcggattgtcacctgaaataacctttatcgcaacaccctgactcttgaaatactcaaatgtctttactgcatttgctctgataggattggcaagtgccacaaatccaagcggagtaacgctgccatttatgccattctccacgttctccccattgtaccttgcaaataaaagtactctgtcgcctttgtcagcgtatggtatgatttcttcctcaatgcgcgcaaagtcttcgtgcatgataaactccggcgctccgagcagataagttccgtcagaaaaagtaacgctgccatatttaaggctcgacgaaaatgcctgctgtgaaaccgctgtacgatgcaatgcagatgtattatttgtcaaagcttccgctgcatatgcttttagtgcgagcatagtcgcattgttgtcaaccgaagcatttgcataatctaaaataagacttttaagctcatctaatgtcaaagctgtctgtgtgccatctgctccactgtttttacagagaaaaatttccttaagcttcatatcaggctcagtaattgtgcccgttttatccacgcacagcacatccactcgtgcaagcgtctcaatacttttcatatcatgaagcaatacctttttccttgcaagcttcatagtgcttagggcaagcgccactgtggtcagcagatacaagccctccggtatcattcctataatcgctgcaactgtcgatgtaacactctttgtgatagactcaccattcacaaaatgactctgccagaacaatataagcccaatcggaataataactatgccaacccatttgacgatcaaattgatggagcgtatcatctctgactgctccttatcacccattgattttgcctcaaggctcagctttgagatatatgattcattaccgaccttttcaagccgtgcatagcactctcccgatacaacaaagcttcccgacatgagcgtgctgccctctgtcttttctacctcatcggcttcacctgtgagcagtgattcatttacctgtatatttccggatatcacaaccgcatccgcacaaatctgctttcctgcggtaagtaaaatcacatcatcctttacaagttcctccgtactaatctgctttacgctgccgtttctgatgacatccgcatgcggagcattcagtaaactcattttttcaagagtcttttttgcgcggatttcctgaacgattccgattaccgtatttccaataattataggcagaaatgtcagatttctgaaagagcctaccattatgagaagtatcgttatgacaagaaaaataaggttaaaatatgtgaaaacgtttgaaatcacaatttcctttgtcgtcttgtctgtagatatatctgttctgttggtaaatccttcctccactctctgccttacctcttcatcggtaaggcccgtgatatttatgctgttgctgtctttgttcatctgattcatgctattcaccgttttccctcattattctacatcataataatgatacattttgaccctttaatcattataatggtacaacatcagcacgatttcaatacctatttcataaaaaaaagatgaactatttcttaaagttctcatttttaaactattaatccattactactcactttcagtctcagtactctcactgtcttccgttgcaatcatatcatctatagaatccggaattgttccaaggattgtggtacttgaaagatatacatcatcatttaccttgatatagtactcaccaagcatagcgtttttctcaccgattgtgatggtatatgtcttgtcagcagtgcttagctttacgacattctgtgattcatccaggccaaaatcagatgtatccgcatctgaatcaaatttctttgaagcaatgatgcttgttgcgtttccaagcagtgatgtgaccttgctcgtattgattttaagagaggtatcattatcgcagacccactgctcgtcatcatctgaatcagaagactctgattctgtgtctgttttctcagactccgttgactcggtctcatcggatgtgtcatctgactttatacggctgaagctatactcctgaccatcaatcagaaatgagaatgatttaacatccgatgagtcgagcgaaagtgcctcaacactgtcgctttcgctctccgaatcatcgtcacttttatatttattgtaatttagaagccccaggtagcctgccagacaggctgccagaactatcgcaagtatcacaaaggtgcgtttctgcttattcattcatttttctcctatttcttatacgcgtttacctgtaatctacttctttctcctcattgcccatacaacgattcctatgataataagcagcattggtacagctatcattatgataagtcccgtaataaccgcctgcagcgtatttatagtgatattgcttaaggtgtaatccttcaccggtatcacacttgatgcaagctcaacatttccggtcattgatgagataacatccttgaacatgtctgcattgttgccggaaacggcattgtcatatgaatcatcaaccacataaggcgtaccaaacacaacaatcgatgcgccggtgcttgaatcatttacagcaagacctgtagtaaacggtccgttctcatctgagtcctctgccttcgatgtggtgatattcttccagtccttctttaaaactgcactgtctgatgtagaaagcagctttgtatatgtcacatcatctgtatcctcaggataactgattgcacagcttcctgccaggaatacatatccgtctgttgcatctgatgtgtaatctgtcgtctcaaccgttggaagcaggtagagaggattctgataatattttgagctgtcattttcagctaccacaccggtcttgaagctgacattgtaagccgcaagtatcttgttaaagtttgtaagctcgtcattatatgcatagcagccgacaatcattgcctttccaccgccatttaaataatcaatcaccttctgtgcgtcttcctcgttgaaatcaacagtcggggaattaatgataatggctgttgcatcctccggcaccttttcctcgttaaagagctctaagctcttaagatttgcatttgccttgcttacaacattctggaaattgcttcctatttccgtttcattgtgtccggttatctgataaattaccgggagctcatctgcatccattgtgacatactctatagcacttgtaatctgtccctcggcatcatagcctgtgatgctagactgcgactggtatccgtaataatatgatgagctgtcatattcatatatatcattgtaatcaatcacctttgaacggtttttgctctcgatgataaggctgtttgtggtaggtgtcgtgtctgtgtaatcctgataaaacttcgggcttgtcgccgggtctacatattttacctttatatgactcgaaagatccttgtatctgttgattgtctcatctatctttgcatccttcgatttcttggaattcaaaacatagattgtgatatcctcatcgagcttacttaccctgtcctttgtatcgcttgtgagcgagtacagctttgtagccgaacagtcaattgatgtgtacttagcaggaagcgttgtcactacaagatttacaaccacacagattgcacacattatgacaatcattcctgctgaaaatgcccctgtgcctatcatcttctttgaaaatgcccatcttctcttctggatagattgagtcgtcaagaaacataaaagcaaagtaaccgtcacataataagctgccgatgtgacactaaagcagccactcacaaaattctcaaatggtgtgtacaaatcaaagcaattaagcacctttgtgagcagattcccacttgacgagatgagccctgtaatggactgcatcatgtatgagaggaataatgccgcaaatgtaagtattgcagatattatcacactctcagatatggacgatataaaaagtcccacggcgatgcatgataaaccgtaaagccagtagccaaacaaagccacatacgcttcactgagcgccaccttgccgtaaattgacaacacgagcggtgaaagtgcaaaaagcgctatgtctatggtgtatactgctgccatcgctaaatattttcctgctacaatccttccgacggatacaggcgatgtcagcatgagctgatctgtctttgtctttttctcatcagaaagcgatctcatcgtgagaattggcactgcaatcatcataataaaaccgattccctttaaatcatatgagatatacggataaccgtttttcagattgtatacataaaaatataggccatacactgcaagaagtgctgcaacaaacagccatcctataacgttttggaaatatgatttgaattctcttttaaatattgcaagcattatttctcatctccttcccctgtaagctcaaggaatacatcctcgagtgacttcacaacagtatgcatctcaaggattggcatatgcattgcacttgcaagctcaaatatttcctcacgtatatcgcagtttgcttttgctataaccatagccttcactgtattctcttcctcagactgttcaaatgtgaccttatcaatatttactatcttctcaagcattcctcttgcaccaatctcgtctgatttgagaacaaggttaatttcctggttctttgacatgagattaatcaggttctctgtggcatcacttgctacaagcttaccctttgatatgataaacacatgatcacacactgcacttatctcacttaaaatatgcgagctaagtatcaccgtatgattttctccaagctttttaataagctcacgaatctctattatctgctttggatcaagtcccactgtaggctcatccagtatgatgatttccgggtagccaagcagtgcctgggcgaagcccactctttgtctgtagcccttggaaaggttctttatgagacggtttttcacctccgtgatgccggtcatgtccatggcatctgctatcatttcttttttctttttcctgtcgagctttttgagctctgccacaaatttgagatactcatataccgtcatatccacataaagcggtggtatctccggcaggtatcctatacatttttttgcctcctcaggctgtgcaaatatatcatagccgtttatctttactgttccaccatcagcaccgatatatccggtaacaatattcatggtggttgactttccggcgccgtttggtcccaaaagtccgtatatctttcccggctcaacagtcagcgaaagatgatctacggccatatggtcgccatatttctttacgagattactaatttctatcacagtaatactccttcctactaaattgttatgatattagagtataaaaaaagagtgttcaatttgtgaattctgaacactcttttgtacattatttataatttttttaatactatgatattttagctgtactaattgtctgggtactaattgtctgcgcgcacaatcatagcttccctttcagcacctgttccgatgaacttaacaggtactccgatgtatttctctatgaagctgatgtatttctgtgcattctcaggaagctcctcgaaagtcttacagcttgcgatttcatctccccagccgccttttagctcctcatatacaggctttgcgttgtttaaaaccttgagatttgtggtaaagtcctctgttacctcaccgtttacatcgtagccgatgcagacttttattgtatcaaacttgccgattgtgtcgagatggtttacagaaagtgctgtaagtccgttaagacgcttggcatattttaaggtgacaaggtctaaccatccgcatcttctcgggcggcctgttgtggtgccgtactcatgtccgagctcacggattttgtctccggttgcgtcaagaagctctgtcacatatggtccctcacctacacggcttgagtatgccttgatgacaccgtatacatttccgatatctgaagcagaaagacctgttcctgtaaggatgccaccgattgtaggatttgatgatgtaacatatggatatgaaccaaagtcgatgtcaaggagtgtagcctgtgctccctcaacaaccacctttttgtcatcctcaagtgccttgtgtaagagggtgattgtatcacatacatatggctcaagctgtgctgcatagtcactgtactctgcaaacatcttgtcgaaatcaagctcctttgtataatcagtctcaggatcatataccttaagaagtgcaagcttaagctctgtctgctccttaaggcgctccttgaaatcaggtgcgtataaatcctccattctgattccgcttctctcatacttatcgcagtatgaaggtccgataccctttcctgtagtaccgattttctttgcctttctcaccttctcaagcgccacatcaagcttgctgtgatatgggaaaatgacatgcgttttgtcactgatttttaagtatttatctacatcatatccgtgctcctttaagttgttgatttcctctaaaagaacctgcggatttaaaactactccgtttccgatcactccgattgtatgtcctgataagagacctgacggaataaggtgcattgcatatttaacaccgtttgctttgattgtgtgaccggcattgtctccgcctgtgcatcttactgctacatcagcgtctgctgcaaggtaatcaattaccttaccttttccttcatcaccatagaaacatcctattactacatctacctttgacattttacatgcctcccttgtattttctgacacgacacattgtgccatgttactgattgattttagtggtatatttatattatgctttataactattaataattatttattacaatactctatcttcttagagcaggctattgcaagcgctccgggtcctatatggcatgagaccgaaagtgaaagcggattcatgactatctcgttatttggaaatgctgcctgaacctcttccttaaatgtctccgctgctgcaatatcatgcgtgtatgccatttcaagatttatctggctgccatccggattattgaagcgcttctcaaaatccgacttcatggcatctatcatgatgctttttgcctgctttacggtacgtgcctttgcaaatgcatcaagcttctcaccctgaatctgaagcaccggtttaagctttaaaagtgtgccaagagctgccgctgctggcgtgattctaccaccctttttgaggtagttaagagtatctaccatgatatatatggaagactcaaactttgcatcctctaatatctgctttatctcagctgcattttttcctgcttctgccaagttcttcgcatctataaccgactggcgcattgtaactgatattctctgattattgactacctgcactttgccgtcataatcctgcgagagcatatatgctgtctcacatgagcttgaaagacctgatgacattggaatgtatacaatctcatcattttcctttaagaactcatcccatttatctgttacatcaccaaccaaaggcatagatgtcttgatatcgccgcctgccgtaagcttctcatagaactgctcctgcgtcagatcgatattctcataatacatctgctcatcgatgtaaaaaggcattggaatcacctcaactccaagcttctttgcctcgtcaggtgtgataccgctgtttgaatcggtaactactataaccttactcattaattctcactccgatataaatattcgttgtcgtattttttccaacaccgcccattataccataggtgtaattgtttgaaaagaagtttttgatgtacttcggcgttattttacctacatcgtagacacggctggcttacaccagcctccgtatattcgcaatccgcacttgcgtgctacttgctcatatccggacattcgtcaaataaaaaatcagaggcaagcgagcttgcctctgattttttattttcctcattgtctacgattacatcatgcccattccggcgccggctccggctggcattgctggagtgtcctctttgattgtagctactgctgactctgttgtaaggagtgttgaagctactgatgttgcattctgtaatgcacttcttgtaacctttacaggatcaaggattccgttatcaaccatatctacatactcttctgtagctgcgttgaagccggttccaggagctgactcctttaccttgttgatgattactgcaccttcaagtcctgcatttgcagcgatatagtaaagtggagcctcgagtgctttaaggataacctttgcacctgtcttctcatctccctcaagtgtatcaacaaactctgcaaccttctttgatgcatggatatatgctgatccaccacctgcgatgattccctcttcaactgctgctcttgtagcgttaagggcatcctccatacgaagcttagcctctttcatctctgtctctgttgcagcacctacacggataactgctacaccgcctgccatcttggcaagacgctcctgtaatttttctttatcaaactcagatgttgtctcatcaatctgaccacggatctggcttactctgcctgcgatagcatccttgtctccggcaccgtcaacgatgactgtgttctccttctgaaccttaactgacttagcacggccaagcatatcgattgttgtatccttgagctcaagtccaagatctgagctgattacctgaccacctgtaaggattgcgatatcctcaagcattgcttttcttctgtcaccatatccaggagcctttacagctactacattgaatgtaccacgaagcttattaacgataagtgttgtaagagcctcgccctcaacatcctcagcgatgataagaagtcttgcaccggcctgaacaatcttctcaagtaatggaagaatatcctggatgtttgaaatcttcttgtcagtaataagaatatacggatcatcaagtactgcttccatcttatccatatctgtgcacatatatgctgagagatatcctctgtcgaactgcataccttctacaaggtcaagctctgtctgcattgtctttgactcttcaattgtgataacaccatcatttgtaaccttttccatagcgtctgctacgagattaccaacttcctcatctcctgctgagatagctgcaaccttagcgatctgctctttgccttttactttctggctcatatccttaagtgcctcaacagctttgtctgtagctctcttcataccacgacgaagcacgattgggtttgctcctgcctcaaggttcttcattccttcctgaaccattgcctgtgtaagaactgtagctgttgttgttccgtctcctgctacatcatttgtctttgtggcaacttccttgacaagctgtgctcccatgttctcgaaagcatcctcaagctcaatctcttttgcgattgtaacaccatcgtttgtgatgagtggtgcaccgtatgatttgtcaagtactacgtttcttccttttggtccaagtgttactctgactgtatttgctaatttatctactccagctccaagtgctgctctggcttctgagccatatttaatttcctttgccatgatttatacgacctttctatttatttatatatttgatatttaattccaaaatgtaagcagctatgaccggatatgtaaaacgtaccggatctttagcttctatccgtaaattaatcttactctactactgcaagaatatcattctgtctaacgatgatgtactcttctccgtcaagcttaacctctgtgcctgcgtatttagaataaataaccttctgtccgactgttacctgcatcttaacttccttgccgtcaaccattccgccaggtcctactgcgataacctcagcctcctgtggcttctcctgtgctgaacttgtaaggatgattcccgattttgttgtttcctctgcttctaactgctttaatactactctgtctgataatggaactaatttcattgtattgcctccttttatctctgttagcactcatttctttcgagtgctaatttctttctgtaaataaaatatcactattgcatttcaatgtcaacagtgatatttcattttaatatttattttacattttctatatcaatccgtaatgctttaacgcatttttcactccatcatctgaaatatcagatgtgacatattccgcaatttctttagccggtggcattgagttgcccatcgcgattccatgtcctacactctcaagcatttcaaggtcatttacactgtcgcctatcgcataggtttcatcaagcgggatatccagatgattgcacagccatttgatgccggttgcctttgaggttcccttcggcacgaactccactacattttccacatgctcaagtatcagaaaatcatcggcaaactcggtcttcacacgttcataatcagtaccatctatcacgtcagcggagaatttattaattcttatctcgccgtcatatcctcttattatatgtgcatgctcaccaagtgactcaaaaaggtaatccacatacggatcatcctcaaagccctcgtcatctatccagtagtctgtggagccctcaagcactacaggcattttacactcagaaagcacccttatgaccttttgtaccatatctgcgctcaggttattttcgtatattactttgccatccatttcaatatagttgccacatgccgcaattattccatcaaaacccatatttaatagcttctctgacctcacactggctctggcacgtccagtacatataaatgccagatgtccgtttgccttgagggctgccacagcctctagggtgctttcaggaattaccatgtcatcgtcccatattgttccgtctatgtcaaaaaatactgttttactcatttgctgctcctaatattattattatcatgtcaaacactgctatcttaacatcttatatgtcaaatttcaatcagtttatctacagtaccaacacctttagaaagcagtaattttgtatgtcaaaaatcccggtgctatgcaccgggattttgctataaaatgtatgaaataaaatttattaaggagaattgctataataatttgttactgtactgagagatatgaatatcccatgagactctcatcaacctctcttgcagcctcacgtccctctctgatagcccatactacaagggactgtccacggtggttatcacctgccacgtatacgttttttacgtttgtagcgtaatgtccctcctgtgtacttacgtttgttctggcattgagctctacaccaaatgcctttgccacatagctttctgttccaaggaagcctgctgctataagcacaagctctgccggaagctttttctctgatccctctaccggaaccatcatgaatctgcctgtcttctcgtcctttttactctcaagacttacaattgtaagctcctttaggttgccgtttttgtccttgtggaactcttttacggttgtcttgtagatacgtggatcatgtccgaataccgcaatggcttcctcctggccgtagtctgtctttaagacctttggccactctggccacggattgtttgcggcacgctctgtaggcggacaaggcatcatctcaagctgtgtgactgatttggcgccctgacggattgcagttccgacacagtcgtttcctgtgtcaccgccaccgataatgactacatttttgccctttgcagatacaaacttgccatctgtcaggtttgaatttaaaagactctttgtattctgggtaagataatcaacagcaaagtaaataccctttgcatctcttccgtctgcctttatgtctcttggatttttggcaccacagcaaaggattaccctgtcatacttcttgtaaagctctgccggctttatatcctttccgacatcacagcctgtgacaaaatgaatgccctcttccttcattatattaacttttctgtcaataatgctcttatcaagcttcatatttggaataccatacatgagcaggccaccgacgcggtcctctctctcatatactgtaacctcatggcctctctggttaagctggtctgctgccgcaagtcctgaagggcccgaaccaatgattgccaccttcttgccggttctgacctttggtggctttggagctgcatatccgtttgcatatgcagtctctattacaccatgctcattgtccctgactgacaccgggctgccccagtgtccacatgtacatgccttctcgcacagtgccgggcatactcttgatgtaaactcagggaaattattggtcttatgcagacgattatatgcctgctcccagttgccggtatatacaagatcgttccactccggaaccaggttgtgcagaggacagcctgatgtcatgcctgctattgtcattcctgactggcagaaaggaactccgcagtccatacaacgggcagcctgtttctgttgattttcttttgaaaggaacacatggaactcgttaaagttcttaatacgctcctttggctctacagacgctgcttcgcatctgtcatattccataaatcctgttggttttcccattatctgcgtcctccttagcctcttgtgctggcataaaatgcctcaatctgtgcctgctctgcgttaagacccttttcttccatctgtacaatagccatctgcatacggttgtaatcgtaaggaataaccttcttgaacttaggaagatactcactgaaatgatcaaggatttccttacccttttctgagtttgtaagtgttacatgctcttttatcatttccttaagctctaatacatcgtacttgtttgagacctcctcagtaaataccatctgcttgttggttctcatgtaaaggtcattgtcctcatcaagcacatatgctattccaccgctcatacctgctgcaaagttttttccggtctttccaaggataactacgcggccacctgtcatgtactcacagccatgatcgccgacaccctcaactactgctgttgcaccggaatttcttacgcagaaacgctcaccggcaacaccgtttatgaaggccttaccgctggtagctccgtaaagtgctacgtttccgatgatgatattatcatccttctcaaacttgactcctgcaggtggatatacgatgagctttccacctgaaagaccctttccgaagtaatcatttgaatctccgacaagctcaagtgtaagtcccttagggataaatgctccaaagctctgtccgcctgcaccgttacacttgataacaaatgtgtcttcatccagcgtatcgtcatatttctttgtaatctcagaaccaaatattgttccgagagatctgtttgtatttgttacctcaatctcaatcgcgcgcttttgtccgctctcaagtgcgctcttaagctgtgtcatgatctcagtcatatcctttgtctttgaaagctcaaagtcatatacctgcttaggatcgaatataacactctgctttttgccgtcaaacggattattaagtatgcagtcaaggtcaatctttgactgtctctcgcttagattatcacgcttctttaagagatctccacgtccaacgagctcatccactgtctttacgccaagctttgccatatactcacgaagctcttcagcgatgaaacgcatgaagttctcaacgtactccggctttcctgcaaagcgcttacgaagctcagggttttgtgtggcaattcctgccggacatgtatctaagttacatactctcatcattacgcagcccattgttacaagcggagctgtcgcaaaaccgaattcctcagctccaagacacgctgctattgccacatcacggccactcatcagcttaccgtctgtctcaattcttactttatttctaagaccattcataagaagagtctggtgtgtctctgcaagtccaagctcccatggaagtcccgcattgtggattgagctgctaggtgcggctcctgttcctccgtcgtagcctgagataagcactacctgtgctccggcctttgcaacgcctgccgcaacagttcctacaccggcctcagaaacgagcttgactgagattcttgcatctctgtttgcattctttaagtcgaatataagctgctccaaatcctcgatagaataaatatcgtggtgtggtggtggagagatgagtgcaacacccggtgttgaaagtcttgtctttgcaatccaaggataaaccttctttccaggtaagtgtccgccctcacccggcttagcaccctgtgccatcttaatctgaatctcctgtgcgcttgttaagtatctgcttgtgacaccaaaacgtcctgaagcaacctgcttgattgctgagcagcggttctttccgtcttttccgattgtgagacgatccttgtcctctccaccctcaccggtatttgattttccgtgcaaatggttcatggcaattgcaagtgtctcatgtgcttccttggaaatagatccgtatgacatagcacctgtcttgaaacgtgtcacaattgagtcaacgctctcaacctcctcgagcttgacacccttcttaggatagttgaaatccatgagtccacggatatttgtatttttctcttcctcgtccacaagtgctgtgtactgtttgaacagattgtagtcaccgcgctgtgtcgactgctggagaagatggattgtagccggattatacagatggtcatcagctccgcttctcatcttgtgtctgcccttgctgtcaagtgtaacatctgtctcaagtccgagcggatcgtaggccgcagagtgaagctcattcacatcgttctcgatatcctgtaatgtaattccaccgatacggcttactgtatttgtgaaatacttatcaataacactcttgtcaataccgattgcctcaaaaatctttgagccctgatatgactggatggttgaaatacccatctttgctgcaatttttacgatacctgtgatgattgcatggttgtaatcatcgattgctgcataataatctttgtcaagcatatgctcgtcaacaagctgcttaactgtatcctgtgccagataagggttgattgcacttgcaccaaagccaagcagtgtagcaaaatgatgaacctctcttggctctcctgactcaagaatgagcgaaagcgatgtcctcttttttgtctttacaagatactgctgcaatgcagcaactgcaagcagtgaaggaattgcaacgtggttctcatcaacacccctgtctgagaggataataatgttggctccgtccctgtatgcacggtcagcctctatataaagtctgtctacagctttctcaagacttgtgttcttgtaatatataataggtaaaacctctaccttaaagccatcggcctttaaattcttaatcttcataaggtcggtgtttgtaaggattggattgttaatcttaagtacacggcagttttccggcttctcctcaagcacatttccggcctcaccgatatagagtgtggttgatgtgacaacctcctcacggattgaatcgataggcgggtttgttacctgtgcgaagcgctgcttaaagtagttgaataacggctccctgttaccggataaagctgcaagcggtgtatcagtacccattgctgctgtgccctcaacaccatttttagccatcggaaggattgaatccttgagtgactcatatgtgtaaccgaaggctctctgcattctctggcgctcttcctttgtatactcaggtactctctggttaggaatctttaaatccttaagatttaccatgtatctgtcaatccactcaccataaggctgcttgtctgcatatctctccttgagctcatcatcatctatgatttttcctgcaacagtatccacaaggagcatctttcccggacggagacgatcttttttcactatctttgtaggatcaatctcaagcactccgacctcagatgaaaggataagataatcatcatctgtcacatagtaacgtgatggacgaagtccgtttctgtcaagcactgctccgactaaatcaccatctgagaatacgattgaagccggaccatcccatggctccatcattgtagcgtaatactgatagaaatccttcttcttctgagtcatgattgaattgtttgcccatggctcaggaatcattatcataacggcaagtggaagctccataccactcattaccaggaattcaagcgcattatcaagcattgctgagtcagatcctgccgcattgataaccggcaaaaccttctggaactcttttttaagcttaggagactccatgttctcctcacgtgctgacatcttgtcagagtttccaagaatagtgttaatctcaccattgtgtacgataaatctgtttggatgagatctctcccagcttggatttgtatttgtagagaatcttgaatgtactgtggcgattgctgactcataatcaggatcctgtaaatccatgaagaactgtctgagctgctctacaaggaacattcccttatatacgattgttctgcttgagaaggaaaccacatatgtattgtcgtttgactgctcgaaaacacgtcttgcaacatacagctttctgtcaaactcaagtcctctctcaacatcctcaggtctttttacaaagcactgcatgatgcatggcatacagtctctggcttttttagaaagcttatcaggctctgtaggcacttctctccatccgagaaattcaaggccttccttctccacgataacctcaagcatcttctttgcctgaatggtcttgaactcatcattaggaaagaaaaacattcccacaccgtaatctctttcgtctccaagatctattccaagtggctttgtaaccttcttaaaaaacttatgagaaatctgaagcaggatgccgacaccgtctcccgtcttaccatcagcgtcttttccggctctgtgctttaagttctcaacaatctttaaagcattctcgactgtctcatgtgttttgatacctttgatatttactactgcaccaattccacagttatcatgctcgtagcgtggatcatataatcccttagctgtggctgtgctttcattccattgtttactcataggttcttcctttcctagtgtaaatttgttaacggataacttattaagaagtgaatcatttcctgtttatgattttacaacgatgaaagctcaatgtaaatagtttttttctcgctattgtctgattatttgataacttaatattataaagttatttttctgactatagctgtatttttatcttttttataagggtatacgcacaatttactttttaaaatcccaaaacttttttcaataaagcaaggcattaaacactgtttcagcaaattgtgtctgaattgtgtatactttacagtaacttttcttggctgatatcataaaaaatcagctatactttttattgtatagctgatttttataaacatccggtaactatcctaaattgcattgctcatattcgtaaaactgcacgatactcgtattttgtctgcactccgtttcggtccatgctaaacagttccttctgtgtgcttcgcataataataaaatatcacagcaccaacaccaagacacatgacagataccacccatgccattacactgccatcaacagtccacttcaaaataccggtctctgtccttatgactgcaaacgcatttgcggtgatatgcccgatcatagccgcatacacatgccctgacttatacataaaagctgcaagcaccaggccaagtaaaaaagcataaacaaactgcactatattaaaatgaatgagtccaaacaaaagcgccgacaaaaatatcgcctgtggcacattcattattttgcgcatatttccaaatacaatgcctctgaaaacaagctcctccataatcggagaaagaattgccgagccaatcagctcaattacaagagtgcttgcataaaagctctcattcgccctggcatatccttctgagagcccgataagcggtgacatggtgatgatattattgagcgcaaatgaaatgaaaagtgtaatcacaatcacccaaagcacatttataaaaagtgccctgtctatctttggttttttaacaaacatctgctgtgtcggcttatagcttgcaaaatacataaatggtattgtaattgcagcagatattatctgcgctatcatgtatgtcgaagctgtgtgtccgataaacgcaaaaataaagtacatcgtacttagaaaaacaatgtagtaaagcacaatcgggacaattatctcccacactatcgctcttaattttaaattcttattcatgaaatcccattcctatctactgtttataacctcaggtctcaatgcattgcattttcataaaagctaatcaaaaagctttgaaagtacatcaggaagctgccttaaatcatctatcacagcttttgctcctgcactcaccatctcgttaacatcgccgaagccaaagcttaccgctatgcttggcacatcgacacggtttgccccctcaatgtcaaacatagtatctccgattaaacacatctcattccttggaatgtctgaccaccggcgcatcacctcgttaagcacctcttcctttgtatctatcctgccgtcaaatgtagctccgaccacctcatcaaacatatccagtattccaaaatgctccaaaatacgctcacacgatttttccggcttcgatgatgcaagtcctatcctatatccggctgctttaagcgcctctatgcattccttggctcccggaaaaagcgaacattcaaatatacctattttgttatagcgctctctgtactttttgaccgcttcaagtgctctctccttagtaaatccgtaatgctccataaatgtgtttatgagtggcggtcctataaagaaaaacaggctgtttctgtccggctcatctatgccaaagtgtgaaagtgcatattgtgccgactttgtgatgccctcagatgagtcaatcagcgttccgtccaaatcaaataatattgctttcatttgttatctccattgttttaaatttattgtacttttaattaaaatgctaggtcagtatctcatttaacactcgtccgacagcatcggcaaactcgttgatactctttatcttcacgagacttctgccgaatatctttgttgcaatctcactgtcatgcgcacttcccatgaagatgccaattacgtctattccatggtttttaagcctctgcacctcatttacggtgtccttaacagcaagagcatcagtgtactccctgtccttataaaaggctccctcccctgctatctgatcatcctgaggacttgcatccgaaaacatgaaaagtaacttctttggctttggacttagctccatcagatgtgatgccgcgcgcagcgcaaggccatccctgttatttcctgccgcaacaaaatgaaataattcatcctccacaccataatcgtcatattccttaaagatgtgcatcaccgtgtagcctcttatgctgcagtatgagtaaatctgcaccggtatgccacaatttgtcaggctctttgacagtacatatgcctgtgccgctattttctgctgcatctgttttctggaagaagacgcatccatcagtatgtcgacagaaaagcccggtgtctccacctcatcttttcgctcaaaaacacgcggattgtccaagtacagggccttccatactctcgcaggctttatacggccgtgtgttgaagcatccataaatgtctcatctgctgtctccaggtgcattctaaggctttctgtaagtctccttatactgttttgatacactgccatgtttttttcaaaatgctctttattcttgtcgtattgcatggctgtctcttttttaaatgcaagaatttccctgcgctctcttttgttgtcaatctcatcaggtacagtctgctttttctccgatgaaatacctctggtaaaaagcaagtgacagtttttgtgatttcctacacagagctttttctccatctcggcctgctgcctgtcagaatacatgctttttccaaagcaggctgtcacataccgcttcgcttctattggatctttctgcagtgcaaactgcagcagatatctctttgaatgctccatagacaaagctgctgtgtccgaggccatatttttatcataaaagctattcgctctgacatactgtgtgctgacttttcctattgagtgaaatgctcctgctaccttctgtaaaaaatatatgccctgtggctttaccacctttatcggcttatacgagaaatacttccacagattttctctcgttttttctataatctcatccgttgtcatatcaggtgtaaaacaaaaagcatgcagtatctcttcatcctctttgcaaatgcctgatggttttccaagtatccttctgcaatgtgcatttctgattatatcaatcctcgaatactctctgtttttattagctcctgcaaggctctttttcgcgtactcaagccttaaatcatataaggcaggcctcgtttgtctctccttttcatacagggcattttccaaacctatccataaaagaccctcataaagcatggcgttttttcctgtcagctgattgaataaggcatctatcttgtcatgctcataccacttgtattcaagcccaataatcagattcagataaatatcagcggatccatcaggtgcaaatgccagaaaaagcggctctatgtcatagtcacaggccgccatccatatgaagtttcttgctctttttgcttcctttatatcctgttcttccatatgttccattccttcatatgtcacaagctcatatcaacaaaacagctgctctctgctcatcttccttgagattcttgcacggattgtatcacggataagcgtctgctcatattcatcaaagctcttgtttgttatacccatatccagagctgtatatatatttaagcccttttccatcataccaattgaaccgatgagaccacgcagatcaagtgcctttgatgatatttcgccatttttgcacttggtatgcagttcaagaaatacctccgcaagctcatttgctcccgcttcacgtattgcaggataatgctcctttatgagcttcacaaggctctcttttgaaatcataggcatccggattaccgcaaaacgtgatacaagagcctcatttagctcctttgtgcctgcatagccgtaattcatcgtggcaataaatcttgttgccggatgaagcgacagtctgtcatagcccggcacatctattgtacgtctgaaatcaagtgtggcatgaagcactgccatagcctcactttttgccatatttatctcatcaagcaccgcaaagccgccggtttttgcggctgtatacacaggtcccggcctgaaggttacttctccggcgcgaaaagtatcggttccgataagtgatgctgcatccatatttacatgaaatgacacatcccagcgtggtctgttaaatacacctgccagattctctgcgaaaagattctttcctgtggccttttctcctactaaaagcagattttctccacacaaaacagctgttatagcctgctcccacacatcgcttccgtaataaaactgtgtaggcacggggattcttgactcatattccttgtccaccggatactgcgagcgaaacttttcaatttccttaatcagattttctgaaatgccaagctctcttaatttgtccaacaagctcatcgcttcctttcatatcagatattttaactgttccaggccatacatactcaaaaccatacacagtttatgctttacgttatattgtcatgcgatatattatttcttcacgcccttagtgtcacggtttgcaatgtgcagcctgtgaagcgccaccttcttaccctttacctcgacctctttttcctcctggtcattaagcagataaatgtcaataagctcatcctctctgtcaagcctcattcccctgacacctactgctgcctttttcttttcaggaatagtgccacagtcgattcgaaggaacatctccttctttgaacgcattaccattgtagcattctctgaaagcatgtcaacaaataacagctcatcatcatccatgagctttgtagcctgcgaggtccttcgtgtcaccacaaactcggcaccatccactagctttatcatggctgacttcgttccaaatataagcttgtgcttttcaacatccataagaggtgctataaatactatatcctccttactgctgtcatagttgcttacattgtcaataggtgtgcccttgtcacggaatttgccgtaaggcaggtctaacaccttgacaagatgcatgtttccgttgtttgtgaaaatgcacagcttatctatatttttgacctttaatatcagcttgttctctgcgtcagctgtctctttgtttctatcataggttgaagtatctactgtcttcacatagccgaagcgatccataagcagcactacatccgatacctcaagctcttttttgaccacaactgcttcctcgagattgtcaagctccgtgcgtctgtcccttgcatactccttgcggaacgctttaagctccttcataatgacctttgccatggatgagcgatgctctaaaatatcgctgtactctgcaatctttgacctggtctcctcgtgctccttaatcagagcctcaatttcgagtccaatcagcttgtacagtcgcatttcaaggatagcagctgcctgacgctcagtaaagcaaagctgggatgccatggcttctgaagcctttgacttgaatttaatcccctctgtctctccgtttatgagacatgcctttgccattttctggtcacggcttcctcttaatatttcaataatcagatctatcacgttacaggcctttatgagtccctgctgtatttcttctttctcctgctcctttgcaagaagtgtctcatactttctttttgcaatctcatactggaaattgacatgatgccttatgatgggtacaagaccaagcgtctcaggtcttccatttgcgacggccagcatatttacaccgaaagtgtcctccagctttgtctttttatacaaaaggttcttaagtgcctcaacatcagcaccttttttaagctctaagacaattcttattccctctttcgatgactggttggttatatccacaatatccgttgtcgcttttgactcgacaagtgaatagacatcatttaagaattttcctatattggcaccaatcattgtgtatgggatttccgtaatgacaagcttgtcctttcctgccttccccttctctatttcgattcttccacggatttttatctttccctgtccggtctcatatattgctgcaagatcatcctgatttgcaacaatgcctcctgtcgggaaatcaggtccctttatatactgcatcatctcggctgtggtgatatcaggatttttcatataagcaatcacaccgtccaccacctcgccaaaattgtgtggcggaatgcttgtagccatgccgactgctataccctcagctccatttatcaaaaggttcggcaccttgaccggaagcacctctggctctttttctgtctcatcgtagtttggaatgaaatcaaccacatttttgtctagatcagcaagatatgcttcctgtgtgattttttgaagtcttgcctcagtataacgcatggcagcggctccgtctccttcgattgaaccaaaattaccgtgtccatcgataagcggcatgccctttttgaaatcctgtgccaaaacaaccatcgcatcatagattgatgaatcgccgtgtggatgatatttacccattgtatcaccgactatacgcgcactctttcggtatggcttgtcgtacctgatgcccagctcatgcatatcataaagtgtacgcctttgtacaggcttaagcccatcgcgcacatccggcagggctcttgctataatgacactcatcgcatagtcaatatatgatttctgcatcagctccgaatattcggtctgaattatattgttgtctacattgttatctatatttctatccatgtctttctccgattataaatactgcttaactattcagaaccactgagaaccaaaagcagaagcgtcatgcttacacatccagctccgcatcatgcgcatgctcgtatatgaactcttttctcggtggcacatcactacccataagcagtgatgtcacatcatttgccaggcgcccatcctctatttcaatacgctttaacatccttgttgcgggatttagtgtggtatcccagagctgatccgcatccatctctccaagccccttatatctttgcaacgtaaacttgcctgtatgtgtctttctgtacttgtcaagctccgcatcgtcatacaaatatttttcctcgccctttgacggaatagccttgtaaagcggaggcatggcaacatatacatgtccctctaaaataagctcaggcataaacctgaagaacagagtcaaaagcagtgtggagatatgagctccgtccacatcagcatcggccataatgatgattttgtcatagcgaagctttgttatatcaaaatcatttccatacccttccgaaaatccgcagccaaacgcatttatcattgtctttatttcagcgtttgccagtaccttatcaatacttgccttttcaacattcaaaatcttgcctcgaatcggcatgattgcctgaaacatacggtttcttgccatctttgccgagcctccggccgaatctccctcgactatgaaaatctcgcacttagaagcatccctgctctcacagtttgcaagctttccgtttgaatcaaaggaaaacttctgctttgtgagcagattggtctttgccttctcctcagcttttctaatctttgcggccttctcagcacatgatattaccgtctttaagacctcaagattcttgtcaaaataaagcggtacctcatcatttgtcaccttggcagttgcacggtttgcatcctgattgtcaagctttgtctttgtctgaccctcgaatctagggtcaggatgctttactgacactacagcagtcatgccgtttctgacatctgctccattgaaattcgcatccttgtcctttaatataccaagctctctggcatatgagtttataatacctgtaaaggctgtcttaaagcctgtgatatgtgctccaccctcagaattgtatatattgttgcaaaaaccaagaatattctcatggaactcgcttgtatactgaaaagccacctcaacctttatattctcactctctcctgtaaaataaatgacatcatgcagcttttctatatttttatttaaatcctttacaaaaccgataataccctcaggctcatgatactcaatatgctctgtctcatcgcctcgtttgtcctcgtatatgattgtaagcttcggattgagatacgcagtctccttaagtctgttctttacatcctcttccttaaatctagtcttctcaaaaatctccgggtcaggcaggaaattaatccttgttcctgtctttttggttttacctatagtaggaagcaggccattttcaagctccacaacaggaacacccttttcatatctgtcatggtggataaagccatctctgcttatctccacatccatatatgtggatagtgcatttacaaccgacgaaccaactccgtgcagacctccgctggtcttgtatacagaattgtcgaattttcctccggcgtgcagtgtagaaaatacaactcgtgccgcagaaacgccctttgcatgcatacctacaggtattccacgtccgttatcctccaccgtacacgaaccgtttttctcaagagttacccttatggtatcacaggcacctgccagatgctcatctacggagttgtccacaatctcatatatcagatggtttagtcccttggttgtgacacttcctatatacatacccggtctttttctgactgcctcaagtccttctaaaattgctatgctcttctcatcgtatgtttgcttcttggccatacttgtctcctacttctttaaattgcgtaataattatattatctgccctgcctgctatccttgatatgcgctaacaccatcgtagctattttgaatatcatagcatcatcaaaggttctgatatcaagacctatcgacttctcaatacgctctagcctgtacacaagcgtatttctatgcacataaagctgtcttgctgtctctgaaatgttcagattgttctcgaagaacttggagattgtagacattgcctcctcatcatcaagtatctgtggcacctcgtcaccaaaaacctcacggataaacatctcacacaggctcattggaagctgataaataagtcttcctatgcccagcctgtcatatgccataatttccttttccacataaaacagcctgccaacctcaagcgccatttttgcctcctgataagactctgcaatctttggaagaacatccgtcggattgccatagcccacccgtaccttaatcatagcctctgcaagcagattgtcaaccagacttcctgcaatagatgaaagcttttcctgaagcttaaccggatctatgtcctcaacatcctttaccagcactacattatgttcatccatcgccaccacaaaatcaccgcttctgatatcagccagattctttacaagctcaacagctatctcattgcagttctttccggtatctataacatatactactcgttttctgttttctatatgtaatttcttggcacggtttattatatcagaaccaagcatattgccaagaagaatattctgaataaaattatttctgtcatatcgctctgactcaccaagcacaagtgtacgaagctgacaaactgccatcctgcctattacaagattctcactcgtatactgacagaacattacaagcacatactcaagctctgaatcaatttcaaccgcaaatgctattgcatcatttttttccctaacatcctcttcggatactataaactccttcacaaaaatgtcgctatgttccggctcttccaccgtacctgtcagatgctttcccttggctgagtataaaatcgcatcaaacgaagtaatattttttatttcctcaagtgattttttcagtttctgattcgtaatcatattcctatcctctcattactgttctgacgcagacaagtaaaaagtctctacaagtcataagctgtaaccttgctataatttaacaccgtaacttaacttttcagaacctcacatacattcgcaaaagaaaaccgggtgtaaattatacacccggtctgtcaatttacaactatttaattttaacgaactagttggtaattgtcaattcagtttctttatcaaatacatgaatcttgtgtggatcaaatgcaagctcaatgtgatcaccgtaacgagctgttgtatctgaatcaactcttgctgacatatttgcgcctgcaactgtgaagtataataatacctctgcaccaagtaactcatatcctgtaacatctgaatcaatcttgcatgtagcaaatttatcaagatgctctgctgaatcgtagatatcctcaggtctgataccgaatactacgttctttcctgcataaccgccatcgataagcttcttagcctttgcctctggaagctcaacctggtatttatcgaatttaaggaatgcctttgctccctcaacaacacactgagcatctacaaagttcatctgtggtgatccaatgaatcctgcaacgaacaggttgtttggctgattgtaaagcttctgtgggctgtctacctgcatgataacaccatctttaagaacaacgattcttgttccaagtgtcatagcctctgtctgatcatgtgtaacgtagatgattgttgcacctaatctgttatgtaatgaagaaatctcagatctcatctgtacacgaagctttgcatcaaggtttgataaaggctcatccataaggaataccttaggattacgaacgattgcacgacccatggcaactcgctgtctctgtccacctgaaagagcctttggcttacggtctaataatttctcaaggtcaaggattcttgctgcctcctcaacttttgccttaatctcatcctttggaacttttctaagcttaagtccaaatgccatgttgtcaaatactgtcatatgtgggtaaagagcgtagttctggaataccattgcgatatcacgatcctttggctctacgtcattcataacctttccgtcgatgataagctctcctgaagaaatctcctcaagacctgcgatcatacgaagtgttgttgattttccacatcctgaaggtcctacgaagatgatgaactctttatcttctacttcaaggttgaaatccttaactgcctcaaatccgtttggataaactttgcaaacgttctttaatgataaacttgccattttaaaaatacctcctaagtattatgtacatatatgtaactgttcagtgccttgactgtctgttaccttgtttctttgtatctttataatacaaaacatatcgtcaattggctatagtcaatccgccaaataatttaacgtgttgttgtcattatgacgaaacacagtctgatatcgaaacaattacaaggtaattactgcaataaacgtactaattacagcttagaatatccaaagccattgaccatagcctcaatcggcagccccttcttgcagaatggacactctgtaacaggatatgtctggtagtttaccacatcatcgtcatcaaacagcttatcaatctttactccattgacctcatcgatggttgagaatatggacgcaatacatgtgaccataccgccataatagttgatacactccatcgctcttctgatcgtctcacctgttgtggtagttgccagaagaagtacaacatgcttgccatctatagcccccttattgttatccctgaaaagcatctgtccgttgttaatctcaggcgatacaacgtaaattgtctcgtgcttattcacagacataagtccgtttctctcaatctcctggcttaagaatgcaccaatcatttctgttccatccatacatacgattgtatctatatatgaatgatgcggtaccttggtgtaaagagcctttgctgcttcctttgcctcggacacacgggtcttgatgcttgtcacatctacataataattaatatgcgaatgactcgtagcaaaatgtcccggtatagcgtgtaagtttaagcctgcactctcctttgatttaaattttacaatacgattttccatgataagtcccccttttcaagtaaagatttgttttaattgtaactcatttgtgattaattagcgcctgtagaaccgaatccaccggcaccgcgcttcgtatctgaaagctctgacacctcattaaactcaacagccagatatggcatgaccacaagctgcgctatacgatctccgggattaatagtgcgtgcctgcgttccatcattgtgaagagccacaatatactctcccctgtaatcactgtcacacacacccacgcagtttgccgggcgaagtgcctgctttgcagctaaaccgcttctggcaaaaactgccccaaaatatccgtcaggaatctctatcgaaagccccgtgcctatctttgctgtctcgtgtggctcaatgacaagctccttagtaatgtcggcatataaatcatagcctgctgcatattcacttccccttgtagggattttggctgtggttgtcaatttttttatatttattttcattttataatttcccctgatgcaattttatatatgactgtctatagccatttattacccaacctgttaactaattatttccactccagacttgagtgctcaatcttcctgtcacgaagcataagctctgagacagcctcctttgccggtttatcctcaaaaagcactctgtttacttcctcgataatcggcatccttacatcatatttttcagcaagggcaagtgcagcctttgctgaatagatgccctctacaaccatcttgacttcttttgttgcttcatccattgtgtatccctgacctatgagcattccggcctttctattacggctgtgacgactctcacatgtaacaataaggtctccgatacctgtcagtccaaaaagtgtctccgcctttgctcccatctcaatcgcaagcacagatatttctgcaattcctctggtaataagcgctgcctttgtattatctccatagccaagtccgtctgccatgcctgctgcaagtgctatgacattcttgagggaacctccaagctccattccaagcacatcaggactggtatacacacgaaatacctcattcataaaaagatcctgtactatctcagcggtcttctgtgtccttgctcctgcaacaacagtcgtaggaagtagctgtccgacctcctctgcatgtgaaggtccacacattacagccacatcagcgcaaggtatctcactctctaccacatcagatatggtcataagagtgttttcttcaattccctttgccacacagacaattatctgtccttccttcacaaacggagccatttttactgctgtgcttctggtgaatacagaaggtaccgcaagtacaagtatatcgttatttttgattgtttcctctatatctgttgtaaaggtaatgctatccggaagctttactccaggaagcttatcaatatgctcatgcttttctttaagcatctcaatctcgctctccacgattgaccatatttcaacagaatgtccgttatttgcaagcaccagggataatgctgttccccagcttcctgcacctataatacctactctactcattttctatgcctcgtattttatataattattataatcaaaaactattatttactttgccttctgaccaaatttattttcagttccacttaaaagtctcttgatattggctctgtgtcgccagatagccatcgccgtaaaacaagcagcaagtatatcaaactcgaccgcataattgccacttactccaagcagccccatatggttaaacacaattgcctgaatcagaaacgatataacaaccagtatagaaccaagcgagacatatcttgttatggctacagcaagaataaacaataccaaacatatcggagccgcaatcggacatacagcaagtatcacacctgatgtacatgctattccctttcctcccttaaaattgagaaagaacggaaaattgtgtccaagcaccgctccaaagcctgcatacagctctatgcatttaacagcctgtggatatgtatttctatatatgaaataaaatatcaaaaccgctatgattgccttgaacaaatcaccaaagaaggtaactgcaccggccttccatccaagtgtccgaagcgtattggtggtgcctgaattaccgcttccatgctctcttacatctattccatgtgccttaccataaaaatatccggtctgaaaggttccaaagaaataccctacgaccaatgctaaaatcctagccagtatcattttactcattttcctttcgttctcttgtaataaacttaagtgcagttcccctgaaaccaaatgtatccctgattctgttctcgagatatctggtatatgagaaatgcataagattcttgtcgtttacaaagattacaaaggtaggcggcttaaccgaaacctgagtcacatagtatatcttaagtctcttgcccttgtctgtaggcggctgctgcatggcaactgcctccgtaacgatctcatttagcactcctgttgcaacacgcattgagttattttctataacaacatcgatgagctcaaatatcttgttgagtctctgacctgattttgccgaaataaacagtatctctgcatatggtataaaacttaatatctgtcggattttctctgtgtgctgctttacggtattattatccttttcaatggcatcccatttattgacagcaatgataattcccttgcctctttcgtgtgcaatacccgcaattttagcatcctgctcagtaactccctctgtagcatctatcactacaatgacaacatcagctctctcaactgcggaaactgcacgtataatactgtatcgctctatatcctcttttatcttattcttgcgcctgagaccggctgtatcgataaatatatactccttaccatcatattttatggctgtatcgatagcatctcttgtggtgcctgctatatctgacactattaccctgtcctcacgggcaagcttgttgataagtgatgacttacctacattaggcttacctactatagcaactctcggtctgtcatcctcatcgtcctgcttagatgaatccggaaaatgctttacaacctcatcaagcatatctccgagtccgagcatcgaagctgcagatataggatgtggatcaccgattcctaagttataaaactcatacacatcagtcatatacttttcaaagctgtccaccttattgacaactaatacaaccggcttgtgtgaacgacgaagcatatccgccacctttgaatcggaatcaacaagtccctgcttcacatctgtaataaaaataataacatctgctgtgtcgatggcaatctgtgcctgctctctcatctgtgacagtatcacgtctccggattccggctcaataccacctgtatcaatcatggtaaaattataatcaagccatgatacatctgcatagattctgtctcttgtgacacccggagtgtcctttactatagatatcctctctcctgcaagcgcattgaagagagtagattttccaacatttggacggcctacgatggccactactggtctgctcatatactctcctgttctaaattcatattagattatagactaattgtaactattcagaataacgataaaataataaacaaaacatctataacagagtaattatatcacaataccatttacagagacaactattcatatgtcaaaagtggttcttttgatgaaattaatccattttctttaagaacagctatcagattagtacagttttcgccaaaactaatgttgaccgaatacgtttcaataccatcggaacgggcatccccaaaatcagaatactcctttgttacccccagtatatccaacagctcctcataccatgtgaagccatcgacattccagctttttccaaccctgttgccctttggcactgtaaaattcagcataagattgtacatatagctggtatccttatccactccgtcaagcattctctgcaaattatattcctgcatcacaccggcatcaacatccttctttacagcatcaaaaatatccgcagcaacttttccgttaaagcgctcattcagcacatctacatatttatcattatactgctctgccgagccattgataaaagtaatatctgtcgtatcacactgcattatagcattaataatattctgtggtttattttcctccgccataatcgccttacactgcttatgtggattaaaatcatccgttatatgatatacacggttgaccttttctccattttttaatgtatatgagattgtaatatacccggaatcatcatatctctttttaaaataatcctttttctgcgccataagtatcttttgagtctctaaaatcttttcaacatcctttccctccagattgatatcaaaatctatggctatacaggcagaatcaatatccgcaagcttcggtatataattttcctgcacatttccgtaaactgttatacctccaaatacaactacaacaaaagcaccaaaagcaatgatttccttaaatagtgctttagaaaaaattttaaaattcttccttataatcatctctaaaagtaagaaggctatgattccaagcaccactgccagcatcataattgcaggaacaccaatgctgattctaagtccaagcagcagcgatgctgtgacagtagataaaatcagtcctccaagacagccaagcacccatctgaaaaccggcttaagtttgggaatggcaataaaacttcctgcattttccaaatctctatgcttataaatcttataagaaataaagtatataactgcagccgcgataacatagactacgatagtatttgtgcctctgaaggtatatttaatacagtaataatcatctcctgctttcttcatggtcggatgaaagcctatccgattgagaagctgtaacatgggtgcaaaccacgtaacacttattttctttacaaattccatatatgaaagcccgtacgatacatatgtgagcacattggcaatagcaataactgctccaccatacagcagattgacaaccgcatacatcaccgccacagaaacaagctgtcctgtaatcattgcgcacagacacaccaggctgtacataaaaaatgatattcccattacagcaagcaaattgattccaatatgtaccatcttcgtattgccatatgatatacatataacaaacgacataatgtacttaattatctgcggaatccacataaacagcagacctgtcaacacattggtcgaaaaaagctgccgcctcgtcacaggcatagagtgaatcatattacaagctctcgaattatacaggtaactgaacattgccatgcctgtaaccaatgccatgacaaaaataaaaatcatatccgcctccatgctgatagccggggatattatatcaagcatatacttatgccagtttttgccataaataaactctgcattcttaaatctgctccacatggaaaaaggaccgttgagtaatagcactattgtatacagtgtccagattggccagtaaagctttacattcttttgcagcattgttctattaataaatgatatctttgacttcatagtcctctcctcccatctcatagataaatatttcctccagagtaagaggcagtacatccactacctgcggactgtctttgccatctgtaatcgcctttactacagcatcaggctctccacgtactataacagtgtatactcttcctatatttgacatatgaagtactttaaaatcctgtggtatcttaggcataccatacggacacgcaatctgaatctttgaaatattgccctgcagctctgtaagagagcgctctatcataatctttcccttattgagaatacctacatgatcacacacatcctccagctcgcgcaggttatgagacgatacaaccactgtagtattatttgcagccacatcatcaagcatgatagaccatatctgtcttctcatgacaggatcaagcccatcaacaggctcatcgagtacaataagctttggtttacagcacagcgcaagccagaaggcaacctgcttctgcatgcccttagagagctttctgatatttcttttaacatctatagatggaaaaaactcctgcatcctgtaaaactgcttctcatcaaagcccggatacattcccttatagtaatgcatcatattaatcgtatcagactgcaaaaaataaaacatatcatccggtatataagccatctgccctttaatccttgcattttcatataccggctcaccatcaataaacacttcccctgcatcctgtctcattacgcctgtaatatgcctgataagtgtagactttccggctccgtttggaccaacaagcccatagacagcacccttttccacgttcatattcacaccatcaagtgccgtaaaatcgtcaaattttttcactaaattatttatctgtatcatcattaccctctgtcacaacatcttctgtctgcatatcttgtgttacaaatctgactaagtcatcttccatgctcagctgctctttcgcatcatccattcttgttctcaattcctcaacaggtgtttcaagcacaaataactctgtcaccacctggtcaaagagtattttcaaattccttgtcagactctgcctggctgtcttagcatcagcaacaaaggtccctttaccacttttagtataaagatagccttcctcctcaagttccctgtatgcttttgcgatagtgttaggattgattgcatacttgcaggcaagcacacgtacagacggtagcttttcgtcctgcttaataacattcataacaatcattcgtctgatgccttccttaatttgttcataaataggctttgaatctcgataatttaactgcatatcgttctcccctgttcatatacgccagtaccgctgtgacttttatattaactcaaagaaccaaaaactgtctggcagcatcagttcccgcacagtgtactatccaacgtgatacacctattttaacatatatagctttaggcatttcttattatttccttaatagattgtgcgaaaattacttaagaaacataaaagctccaagatttccacgctttccatgacttgctctatgtgaaaataaaagagagggattacaacaagtgcatatattgcttatggcaatattgtcttcctgcactcctgcctccacaagcactctcctgttacattcccaaaggtcgagctgatatttgccagctcccttatagagcagaatatcactcgcatgaggatcgtctgttgtcgcaaactcatccacaaaatgctctgcaacatcctgacttatctcatagcagtcctgacatattgaaggtcctatcgcagctataacatcatgtgcctcggtaccaaactccctgttcatagcaataagtgtctcttttcccatacgatttacagtacctctccagcctgaatggctaagccctattgccctatgtaccggatcaacaaaataaagcggtacacaatcagcataaaatgtggcaagcacaacatttggctcattcgtgataagtccgtccacatctgtatatggtctctttcttgtcaccccgatgccacactgcttttttccaactctcaaaacattggtagtatgtgtctggtctgtcgtaacaatctgtcctgcctctgctccgattgcctccgccactcttttataattttctaagacctttctctcgtcatcaccgcgcgtaaagcttagatttaagctttcaaacatcccttcactgagtccaccaagacgtgttgtaaagcaatgctccatcatagaaagctcatttagcttcctaaaatgtaacaaaggaacaacacttccgcttgaaaggacgtgcttttttaattccagaacatctttatcattctttgtaacaaaatcatttatagtaatttcatcatcatttttgtgtatgttttcagcctgcatattcttatccatctttatattcttttccttctttatattcttatcaatgtcttcatatttatatctatgcaactatatattaccgataactattgctgtttacaatttcctgttccttatctgttttcatgaaatagtctggtcaaacgtttataaattaacgtttccgtaatacctgtccataactgccaagccaatagttattgactgccctcaaatgcattcttcaacacagtaatctcgtcatcatccactgctatcacatcaaatctgcatggtgtccactcatccaaaccatgtttcataagataataccttgcaactgatataatttttttctgcttgctataaccaactgcttcaagagccctgccgcagccgttatctctacgatatttcacctcacaaaaacatattgtatctccatccttggctattatatctatctctccaaagcggtttctgtaattgcaggcaagtacactatatcccatatttattaactgctcagctgcaagctgctcatatatacttccaacacttcttttattcataactgcctcacatatcatataacctacacactatctttggtcaatttttgccttaagcttatccagatcattaacaaaaacaagtatctctgcaacaacctcatacaactccgttggaatcatatcacctattttaagcctagacagtgtatcagcaagcttatcgtccttatatgtaggcacattgctttccttagccctctcaataattttgtcagcaataacgcccttgcctgtagctagtattttaggtgctgcttctcccggcacatactctatagctacggctgttttgcctatgtctattccattattgttgcgattatcattttcgccatgcatacaactcacctgtccttctgaagtaagttttaatcatctgtgactattcgtaaattatcttatacactgctacgccctaatgtcaaaggaatatctatgcacctgacctgtaggtggcaaatcctttttcagaaatccagcgacaaaattcatctgtttcgaaccactatttacattcaattcacaattatagcccttatcctgtaatctcttttccaacaccggcagaaattgctttaccagtgcatatgactcatcactatccaaatagaaattagttgtaaccttcctatgaagcattttaattgacacatctgtcccaccgagatgctctaaatccaaatgtaaaaatgctgataattctttgtccggattggacatacttttcttatttgtatacacatacaactgtccgctggcgtttttttcattcatcttcaatggaacctgcacatatgtatatgcctcgtttatctgattcataaattcaatatttccacggatattatctgccagtgcctctgctttaggattcaccactcctgatgttttcaaaataatttccatatttgttatctgtttttcaattttgtcgtacaagccatcaagcttcttaggattcttctctaaatctcccggtttaatcatccattgctgttctaaagcctccttcaacataagcttaaaggcttctcctgaaaacaaatgtctcagtgtatcggcatttgccggtgtattttccaacatactttttatatcgttaagtattcctacgacactgctatcctctgaatacaaagaaatattgttttcctgtaaattcggaagcagcatcctgacctgttcattaagctcttctatctgcttatccgataaaagaaatccaatagtatttgattttgtttcattctcctgtaaaaggatggtatctgttgccggagcattgtttattttctgcgttgtgtgaatgtcctgtgattcaccggaaacactgtttaatgattcaaataattcagcaatattaaagtgtttttttactacaggtgccgattgattatcacgaattattgcctcatactgtgacatatcagaagcttcacttgatataaatgcctcttccggcagcccttctgtaacaatatttaaaatatcccttgcctgggttacaagcttatacattgataaatcttcggctgaaagagcattcggcagttcatctatcaaactatccatagcaattgtaatagcctgtttgtcattagcataattttcaaactgagctgcatttacctgattaatttcaattccaagcctctttaactcaacaagtgtagtcacattaatatccttattatcctgcacaagctgatacatctgattaaggcttgtcttatcaattggcatctgctcttccatcatcttgttcaccatcgacaaatttatgccatccaccggcagtcctgcagactttagcgcatccataagtgtgaggttggctccctcgccatcaactgtatatggttttatttctatagtgcctccatcattatttttcacctgaaaaaacacagactgtccctgttcaaatgaaaactttcctgccagccttgccaaaatctgctgaccatttgacaaggcaagcttaacctgattgccacggacactgcttactgttccctcaaatatcatcccttttgacatttcatttaaagaagataccagcttttcaacgccctttgctcctgtcataggctcaccatttgccactgaattgttgtattgacttaccaaatttgatatctgcatagcatcaccctgatatagtatcgttatgtttaagtatacatgtataaattgtatcatttattggtatttctgtcactatattactgttcacacaccacagtgtaaccgcaacaattgatttctttcaaaaatcaggtaaattccaccatattcttcctataccactttggacaaagattgcgctgacattgtggattgaaccgctcccttatatcagtgtgctcaaaatacaccttccataactgctcaaaactgtctgtcttcaccggcacacttatctcaagctgcttaaattcactttcattgatataaaagcactccttaagcctcgggtggaccactgcataccttcttctatcatcatagattacaaaattttccccgggatacctgtccacaaaatgccacataacaaccggtatcatatcgcattttggttcaaagtgcgccagcagatagtttccattatcactaaaacgaataaaccctcttatcttgtcagcctctttatttacctttcttgaaagctcaaatacctccataacatatttatcggtcatatactccataatcctttgtcccaccttaaatgctctgacaagaaatccaagcactattgttgctctattatcagaataatggcacaaagcatcaaatacagtctcatatatcttaaaaccaagcttcttttgaattgtcaaaattgtcttttggacctttacctcatctgtttcaatatctatcatctttgaaaaaagtgtatagtttcctccaatgcctatctcaatagaaatattgtcccggtatacttcgtgattttctttttgcatttgatttttgtatacaaaagcatcatatatagcggtaaaaatcccatttatattattatcacatctaagtattatattatccatgcatccttctccctgcagctttacaaaaatattgtctattcagatataaaatcaaatatactcatctgctcataagtacatgatttattatcagctaaaagcatagtatccggcctttcgttatatatgagatgccttgtaatatagctttcatcaagctttgtattgtacatcatacgaccatcacaggtgataaagtacagtgctcttttgagcacgacacccattttctttaaatctgtaaacgaaagctttgcatgctttctggcttttataatacgcctgacactgttagtgcctattcccgggaccctgagaagtgtataataatccgccgtcataatctcaaccggaaaacactccagatgacctacagcccactgacactttggatcaatataatcattaaagttctgattatcctccgacaaaagctctcctgccttaaagccataaaatctcataagaaaatctgcctgataaagcctgtgctctctctttaacggtggcggctgcccgatacccggtaatgactcatccatattaacattcacaaaagccgagtaaaatactctcttcatatcaaacctgttgtacattgcttctgctacagatataatctgataatcactctctccggttgctcccacaatcatctgtgtactctgccccgccggcacataatatctgtccggtcttttgatacttaagcctgattcccagcttttttgtgcaagcttatcagccttcccgcaatctgtagcaaccctaaggcttctgtgatactctgataatcttgcagtactatcttttatttcggccatctgctcataatatgcctgctcatctatatacatacggtttttcatactgctattgccatgatacattcggctgtcctttataccattttgaataaatctcataggtgtaagaatgtttttacgcgccttattcggagcaactgccctaagcccttccgctgtgggcaactccagattaacactcatcctatcacaaaaatatccaatcatctcaaggacctcagaagaggctcccggtatacccttgatgtgtatatacccattgaaatgatatttgtttctcaaaagaaaaagcgtggtatataaaagctgcatggtatgctcgggcgattctatgataccggagcttaagaaaagtccctctatataattgcgtctgtaaaactcaacagtaagcttacatacctcctcaggcgtaaatgtcactctttcaacatcattagtgcatctgttgatacagtatttacaatcataaatacattcatttgtaaaaagtatcttgagaagcgatatacacctgccatcagctgtaaatgaatgacatattccactggcaaatgcactccccatatcagttccattacccgaacgggatgcaccactggaagtgcatgcaacatcaaactttgccgcatcagacagaatcttaagtttttccataatatcagcactgattgacgttaacataaggcctccttatattatttcgaacatctgtttgcattatacaacatatgttcgggtgaatcaagtaaaaatttttggaaaaatattgttatggttcataaacacaaaaaccatagatatcttaaatgcattaagatactatggtttttattttttaataattatcgtaactattcagttgcaaaaaatatcgtagcctttataaacagactttattccgactaaaaaaattttcttaagagctactgtatgacatgattttatcccaatttagtcttaaaaaactcgattatcctatcccacagttcatcctggaaaaactgcaaatccgcatggtcagcgccttctaatgcaatcaaatctgcatcacagccattttcaataagcttgtcataaagctcttcactctgctcaaacggaactgtctgatcatttataccgtgaataatcaaaaatggaggagcatcttttgtcaccttagacaccggagaactgttgtatgattccttgatatttctcataatattatatccgagtaaaagtgactccatagatgctgcgcattcttcggcatctttatacttaaatgtgctaaggttagtaggtggataccatggacatgctgcctgaatactgcttgactcttcaagatattctccaacatcacgagctttatcatgatccaatgccgccatacatgtcaaaaatcctccggctgattctcccatcgcaccaaaatgttccttgtcaattctgtatctatctgcatgtgccttcaaatacctgattgcagccttcacatcctctatctgcataggatagcaaccctcatttgatgtgcggtattccacactgcaaacaacaaaaccctgatgagcaagcgtactaagatatgatagatgtgctgacttatcaatcctcatccatccaccaccgcatatccatactatacaaggataacgcttgtcagacatatcttccggatatattaaatcgagttttaaatccctgcgacagtgatcataccacgaatccacctgcgcatatgtaatatcagatacctgcacatattgtggcttcgtcacattaatcttaagtttttccttcatttcaaaatcctccttacatttgtaatccattttgaaatacaaaattaatatcatttaaaataaatactttatgcccattataatacatctattttcatttttaaacaaaaaaaaccttgaaacaactatcttgcttcaaggtttaataacaggggatgagagaatcgaactcccgctaaaagttttggagacttctgtcataccatttgaccaatcccctatattcaaatattatatcaaatatagaaaaaggacgcaataggaattacgtcttattttaatgtaccttcaaaacttcatacaaatttaattactgtaatccataccgaaaaactcatctcgattccgcttcgcttcatctcgatggatttgcttcgcaaatctgcgtccaattaaatccagatttgtgcagacacgtctgcaaaatccgtatttcattgtacttgtttttctccgttattaaccagattaagccctcgacctattagtaacagtcagctccacatgttgccatgcttccacctctgccctatctaccttgtagtcttcaaggggtcttactcccgaaggagggatatctcatcttgaggggggcttcacgcttagatgccttcagcgtttatcccttccagacttggctactctgccatgccgttggtcgacaacagatacaccagtggtccgtccatcccggtcctctcgtactaaggacagctcctctcaaatatcctccgcccgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctactttcgtacctgctccacccgtcggtgtcgcagtcaagctcccttctgcctttgcactcttcaaatggtttccaaccattctgagggaacctttgagcgcctccgataccctttcggaggcgaccgccccagtcaaactccccgcctgacattgtcccattgccagttcatggcaactggttagaaacccagtactacaggggtggtatcccaacagcgactccggacagactggcgtccatccttcttcgtctcccacctatcctgtacatgcagtaccgaatcccagtatcaaactggagtaaagctccatggggtctttccgtcctggcgcgggtaaccagcatcttcactggtacttcaatttcaccggatgcattgtcgagacagtgctcaaatcattacgcctttcgtgcgggtcggaacttacccgacaaggaatttcgctaccttaggaccgttatagttacggccgccgtttactggggcttaaattcaaagcttcgcttacgctaacctctcctcttaaccttccagcaccgggcaggcgtcagcccatatacttcacctttcggtttcgcatagacctgtgtttttgctaaacagttgcttgagcctattctctgcggcctgctctcgcaggcaccccttctcccgaagttacggggtcattttgccgaattccttaacaatgcttcttccgtcggccttaggattctctcctcatccacctgtgtcggtttacggtacgggcacgcattacacaatagcagcttttctcggcacatggctcacacgcttcactactttatttcgctccacatcacgtcttcggattatacaacggatttgcctgttgtacacctaccccgcttgtaccggtttttccattcccggcccgtgctttccacatgcgtccctacagttctgataatgcgtggtacaggaatctaaacctgttatccatcgcttacgtcttgcgacctgtgcttaggccccgacttacccagagcagatcagctttactctggaaaccttagatattcggccgaaaggattcccacctttctctcgctactcattccggcattctctcttcttatccctccactgctccttccggtacagcttcgtcggttttaagaatgctcctctaccactcgcattgcgagtccacggcttcggtgtcgtgtttcagccccggacattttcggcgcaggaactctcgactagtgagctgttacgcactctttgaatgtatggctgcttctgagccaacatcctagttgtcttcgaattcccacatccttttccacttaacacgcactttgggaccttagccggtggtctgggctctttcccttttgactgcccaacttatctcgtgcagtctgactcccgatcatcatctacatggcattcggagtttgatattctttggtaagctttgacgcccccgcggaaattcagtgctctacctccataagactaaatcgaggctagccctaaagctatttcgaggagaaccagctatctccgggttcgattggaatttctcccctatccacacctcatgcccacccttttcaacggatgtggcttcggtcctccattgtcttttacgacaacttcaacctggacatggatagatcacccggtttcgggtctgcgtacactgacttaacgccctgttaagacttggtatcccttcggctccgcaccttaagtgcttaaccttgccagtgtccgcaactcgccggaccgttctacaaaaagtacgcggttgttcatttaaagaacttccacagcttgtaaacacagggtttcaggttctctttcactcccctcccggggtccttttcacctttccttcacagtactatgcgctatcggtcactaagtagtatttaggcttacggggtggtccccgctcattccatcaaggtttctcgtgtctcgatgtactctggatcccgctcagtcagttttcctttcgcttacggggctttcaccctctccggcaggctttcccaaacctttctgctagaatcactgaatcttaaatgcggtccgaaccccggagtgcacgcactccggtttggcctctttcgctttcgctcgccgctactaacaaaatcgatgtttctttctcttcctccggctacttagatgtttcagttcaccgggttcccctccatacgttatggattggcgtatggatgatacgagttcttcgtaccgggtttccccattcagacatctgcggatcaaggattatttgcatctccccgcagcttttcgcagcttatcacgtctttcttcggctcttagtgccaaggcatccaccctgcgctcttttttgcttaatctcttcgatgcatagcgttgcatcattaataacttaaagaactttgttgttgttcacaacttggttttgtttctcggatgtcttgattgttagatattcttaagaatagaatatttattcatcaaatcatttgtatgaagttttcaaggtacactgctgtgattaccagttttagttctcacagactttttgactgttttatcagtcattagaaatcttaatctcttaaaatctctaatcactggtaaaaccagctatctaaacagcacttccctgctgatgtaggttagctctttcgagcctgttctattttgaaagcatatatgctatgctgttctttataaatccggcagccacctaccttcccataccgttaccagtatagtattatcggccgcttcagtcttaaccatcgtgttcgggatgtggacgggtgtttcccaaaagcgcatcgccaccggaagtttgaacacttagcgaggtgttttcgagcttagtgtgaaacttgttcgatttgcgaaagcaaagtcaaacttcctcagctcaccccagtgttatttgttattaaataatcattaataactcaacagtgaaaaactctctactcgatttccttagaaaggaggtgatccagccgcaccttccgatacggctaccttgttacgacttcaccccagttatcgagcctgccttcgacagctccttcctttcggttaggtcactggcttcgggcattcccaactcccatggtgtgacgggcggtgtgtacaagacccgggaacgtattcaccgcagcattctgatctgcgattactagcgattccagcttcgtgtagtcgggttgcagactacagtccgaactgagacgttatttttgagatttgctcagcttcacagctttgcttccctttgtttacgccattgtagcacgtgtgtagcccaagtcataaggggcatgatgatttgacgtcatccccgccttcctccaggttatccctggcagtctctctagagtgcccggctaaaccgctggctactaaagataagggttgcgctcgttgcgggacttaacccaacatctcacgacacgagctgacgacaaccatgcaccacctgtcactcctgctccgaagagaaggtacggttaagtaccggtcagaaggatgtcaagacttggtaaggttcttcgcgttgcttcgaattaaaccacatgctccaccgcttgtgcgggtccccgtcaattcctttgagtttcattcttgcgaacgtactccccaggtggaatacttactgcgtttgcgacggcaccgagaagcaatgcttcccaacacctagtattcatcgtttacggcgtggactaccagggtatctaatcctgtttgctccccacgctttcgagcctcagcgtcagttatcgtccagtaagccgccttcgccactggtgttcctcctaatatctacgcatttcaccgctacactaggaattccgcttacccctccgacactctagtacgacagtttccaatgcagtaccggggttgagccccgggctttcacatcagacttgccgcaccgcctgcgctccctttacacccagtaaatccggataacgcttgcaccatacgtattaccgcggctgctggcacgtatttagccggtgcttcttagtcaggtaccgtcattatcttccctgctgatagagctttacataccgaaatacttcttcgctcacgcggcgtcgctgcatcaggctttcgcccattgtgcaatattccccactgctgcctcccgtaggagtttgggccgtgtctcagtcccaatgtggccggtcaccctctcaggtcggctatggatcgtcgccttggtgggccgttacctcaccaactagctaatccaacgcgggtccatcttataccaccggagtttttcacactgcatcatgcgatgccgtgcgcttatgcggtattagcagccgtttccaactgttatccccctgtacaaggcaggttacccacgcgttactcacccgtccgccactcagtcacaaaataatcagtcccgaaggaaatcaaataaagtgcttcgttcgacttgcatgtgttaagcacgccgccagcgttcatcctgagccaggatcaaactctcatgttaaaaagttgatctcagtcaagttaaacttggctaattcgttcattcagatagaatctgaatttactgttttaaaggtcttcaattttcattgaagcgttctgattgattctcaaaatctttcaaggtttctcactgttcagttatcaatgttctttgttttgctctcttgcgacagcttgattattttaccaaatcactgttcgtttgtcaagcatttttttatttttttgaactctgttttaagttctctgtcttgcgacagcttgtttattctatcaaaatgtttttcatttgtcaagaacttttttcataacttcttcaacttattttcaaagcaatatctataaagtcatgtctgtaaaatgtaactcacaagctctacaactcaatgtgtcccgcgagtcagctttgatataatatcatcccggcacacatatgtcaacggatttactgcaattaattaaagtagtaaaactatcttaaaaagcacaaattttctaaattgtctgtttattatatgcaattctcacaattactatctgacagcctctattgcttccttgatatttgccacaccgacaatctcaattccactaatatgcgacactcctgcaagacacactttgggaacaatacactttttaaagccaagcttctttgcctcagcaacacgctgctcggacatggtaactccgcgtacctctccgcttaagcccacctctccaaagcatatggtatcctcacgcactataatatcctttttgcttgatgcgattgcaagcactatcccaaggtctatcgccggttcgttcatccttataccgcctgctatattcacataagcgtcacagtctgacagtgacaggttggctcttttttcaaggaccgccatgagtagatttactttattataatctgtaccatttgctgtacgccttggattattaaaaaagctgtgacatacaagagcctgtatctcgagaagtatcggacggcttccctctatggaacatgtgacaattgatcctgatgctccctcgggcttaccgctaagcatatactccgacggattttccacctcaacaagtccctccgccttcatttcaaatacgcctatctcattggtcgaaccaaatctgttcttaacacctctaagtatcctgtacgactcatacctgtcaccctcaaaataaagcacagtatcaaccatatgctctaacgtcctcggccccgcaaccgcaccatcctttgtcacatgtcctactataaaaacagaaatacccagagtctttgcaagctgcataagcactccggttgtctccctgacctgtgagacactgcccggtgccgacgctatctcctcattgtacatagtctggatggaatctattacaacaacctccggtttttttcgttgaatcacgtcctttgctatatcaagacttgtctcacataaaagctccagtgaatcggtaaaatcaccaagtctgtcggcacgcatctttatctgatgcagggattcctcacctgacacataaagtaatggcacctttttttgtgaaagttccctgcatacctgaagtagaagcgtggattttcctatacccggatctcctcccacaagcacaagtgaccccctcacaattcctccaccaagtactctgtcaaactcggctatacctgtcactatacgctcctctttctcgctttttactgccgaaagaggcagaacctgtgacgcctttgattctttttttacttttcccgacgagcttatcgactttttatctacggtctcctctacaaatgtattccattccttacaggccgggcactgtcccatccattttgccgattcataaccacattcctggcagaaaaatacagaggtctttccttttgccatattgttctcctttataaaaatacaaaaagcccggctttcaccgggctaaaaatatgctctattttcttgatactttgatatcgactgaatcaacaccctcaagctctacgcttaagctgagcttgccgccgagatttgtcttcatagtacctgcaacagctccagctatatcaatttcgtactccgtctcctcttcaaggccaagagtaatctgagcatcctcaggtccctccacagtaaatgtcactgtatcagcagtctcctcgaaatccataaccgctgttcccggaacagactcgtatacaaagagtccgtttctttcgagctttgtaatctccttaaaggtctttaccttgtagatatctccatccttctcaaaattgtcaagctttgcctttgcagccaatgtataatctccgaagctgagctttccgttttcctcagtacggattaattcacttattacagccatttttatcctcccgtagctatattgatatattaattataaatccaattctactcaacagtcaatgaaatttgtttgtttttcgtagaaattattaccttatcgccgcgcttaattttgccggtaataatatcctctgacatacggtcttcaatctcctcctgaagttttcgtttaagaggtcttgcgccatattttctgtcataggctttgtccacgataaaggattttgcactgtcgcgcactgtgagctctatatcaagctgttctttacagcgtttcttaagctcctttacaagaagtgtcactatatgcttcatgtcatccttgttgagagctctaaatacaatagtctcgtcgattcggttcaaaaactcaggtttaaatatacggcggacctcctccatgacactgttcttcatacgctcgtgatcctgcttttcatcctcaccagcgccaaagccaaggcgctttggttctataatagaagaagctcctgcatttgatgtcatgatgattattgtattcttgaaatcaaccgtgcgcccctgtgaatcagtgattctaccatcatcaagcacctgtaaaagtatattgaacacatcaggatgtgctttttctatctcatcaaacagtataacagaaaaaggattgcgtctgaccttctctgagagctgtccaccctcctcatggcccacatatcccggtggtgaaccaatcatctttgaaacactatgcttttccatgtactctgacatgtcaacacgtatcatggcatcttctttgccaaagacagcctcagcaagcgcctttgacacctccgtcttacctactcctgtcggtcccaaaaacaggaatgagccaatcggcttcttaggatcctttaaaccaacacggcctcgcctgactgcctttgcaacagcagaaacagcctcctcctgtcctattacacgcttgtgaagtatctgttcaagctttgcaagtcgtcctgcctctgactctgtaagcttatttacaggtattttggtccatcccgatactacatccgctatctcattttcgccgactacaggctgatttttggctcctgtgcgacagttctttctcataagcttctgctgtttattttcaagtacttccttttctgacataagcgcgccggcagctgcgagatctccattcgataaagcattttccacctggttctgcttatctgttatctcttttttcagagcaagcaactcgtcagatgatgtcagattcttaagccttatcctggctgccgcttcatccatcaggtctatcgccttatcaggtaaaaatctgtcatttatatatcgtgcagaaaggtttactgctgctttcacaccctcatctgttatgatgacaccatgatgcttttcatagattccctttaatcctgtgagtatctctattgtctcatccacaccaggctcttcaaccatcaccggctggaaacggcgctcaagcgcagcatccttttccacgtatttgcggtactcttctatggtagtggcgccgattacctgtacctcgcctctggcaagtgccggctttaatatgttagatgcatctaacgagccttctgctcctcctgcacctattatagtgtgaagctcatcaatgaaaagcagtacatttttggcatttgaaacctcgcttatcaccttcttgatacgctcctcaaactcaccacgatactttgatttggctacaagcccggacatatcaagggaaaccagtctctttcccaaaagaatatccggaacattgccactgactatatcctgcgcaagtccttctactatagcggtcttgcccactcccggctctccaatcagacatggattgtttttgccacggcggcaaagtatctggataacgcgctccatctccttttttctgcctataacaggatcaagaagtcctgcctctgccatatctgtcaaatctctggaatactgatctaatacaggagtcgcagaattgtatgatgtactgtagcttttcatcagatccctgtatgcagacggatcctcacccatcgcaccaagaatatctataaacatcttctgactgttaacacccatggtgtttaaaagtcttgcagctgcacagtctccctgcagtactatagccatcagcaagtgttctgtacctatctcattgcactcaaatctatcggcttcctccgatgcacgctccaatactctctgtgtccttggtgaatagccatccctgtccatcacttcgatgttatcccccggtgaaatcaggtcttcaatcatcgaaataagcttatcatattccacattgcaggctgttagaacctcagctgccacaccggtgccctcttttataaggccagccagtatgtgctctgttccaacatagctgtaattcattttctttgatatacgtgcagccaaatctattgcttttttagccttacttgtatatggtttcaagtcatatcctccagtcatattcactaatttaagtcgatgaactgcaaatcatcatcctcgctgtcatcttcattatcatcctttgcactgctgtctatagtctcagacggcttatttccctcattgacaaatccatcaagtgccctttgaagctgattctttaaagcatcctcatcagcatcgttttctgtgtcagaaacgttttcctgccttgaatcgtcttttaaatcaaactcagagttttcattctcaacagctttcttagaatcaggtgtaatttctacggttcttccgacataggatgcatttgatatattttcatccgtagccatcttttgctcatctgcagcaccttccgctgtttcttctgcgacttcatctgccggctcttctacagcttcatctgctgtttcttctgcagcttcttcttccacttcatctaacgactcttctgtaacctcttcttccggctcatctgctatctcgtccgcagtttcatcagttgtttcttccaaagcttcatttgatacatcttctgctgcatcatctacatcatcatcgtcatcatgatagtccattgccttatattttctgtttttcacagctgatacaataagcaacagtaacagaataatgataataagaaccagtattgcagctaaaacaagatatttattggcaattcccggaacaagttcactctttaccgcatcgttttcctcctgtgccactgtaggtgtgctgagctcggtcctcatatatgtgccatctacgctatcatatgtgtaccagccactctcaccattgtcattcatagcgtatacgaggtaaaaatcctttgtctgatcatcggttttttcgactttggtctggtaggctgttgccacacccttgccctctatggagagcgatatctcattatatccctcaggcacatcatccaccttaggcagtaaaaccactataaaatgcgactctgaattgatacggacaaactcatatgctgcattctgtgctgcatcatatacaaaaagtccattgccgctttccgactgtaaatacacaagcgtgatatcaccaaaggtgccatgaagggtattgtattcaagtccgtcaatcactgtctttgagtgctcaaagccttcaggaacaacatcctccggaatgtcatttaccatagtccactctgtgccatttatatcgaacttcttccagttatcctgcttatctgcattctccggatcatcctcggctcttctggtaacaactatattgtatgtacttgtgctgccatcctcagctgtcacaacgacgctgaccgtattctctccaacctcaagtgaatcatttcctgtgacggatgtcacactcgccttggaatcagccggatttgctgtaaccgcaaggcttgaacagctgtaatctactgtagctgtataatcctttgtcgcagcagaaaactcaggggaaagcgtacctgctgagataacaagcgaaccaagagatgcgtttgaggatttcttttcctctttgttttcattatctttatttgcattgttgtcattgccggtattgctgccagaattgtccttgttatccttgttgctgtttgaatcattgtttgatgaagcacttgttacggtcaccttcgtgctggcacctgtgattgtgcctccggcatcgttaccctctgcatctcctaccactgtacaatacgcctttatagtgcagcttcctgcgcccttcgctgtaaatgaaaatgactgcgatgtaggatatccggcagcgtcaccaatatttgccacaccatcgcctccgttactcagcactccctcgtcagagcttgagataactactgtaccaaaatatcctgacggcatagaaaccgtcaccttgactgtttttccaacagctacagagcttgagctgacacttaatccaagtccctgcgcatatacatgctcggcaggtgcgaaaacaagcatcaccgccataacaagtgataatatacatccaaataatttcttcatatttttcctcacatttctaattctgcgatatctttgatttgcccagtatatgtctgttcatgattatcatatcaagggcatttccaccatcacgctttctgttagcatcagctgcctccagataagcacctgtgagtgttccctttcctaagatatgtctgttgagcttaatcatatcaagagcatttacagcaccatcaccattgatatctccatatataacaatatcgtatgtctttttcagattacctgaagcatcataaacagccactttattgcctgttgcaatctttccgctgttttctgagcctgagcttgtcaaaagctttacagtacctgatgctgatactgctatattcttcacaaaatcagctgcaccggttccaggctcaatgcctgtaatataagtacctatactgtatttacctgatgttatgtttacatctgtattattttggttattattgttctgattattattgccacctgcattatttgcagatgccgcctgcctgtttatattgatagtgtatgttcttgtatcaccgctttgcgacttgcattttaccttaattgtattatttccgacagcaagcgaatagcttcctgtgcctgaaacaccactgtttcctgaaactgcatctgccgaaacagtcactgagcttatggcatttgaaacaactgctgaatagcttgttgtcgctccattgaaggccggtgtgagtgttacaccacttatcgcaagcgactgcagatagttattggtatcgccagctttatcgaagcccactgctgacgatggcatattgttgtatacaggtattttaaatacaaaagcctgattcctgtctgaatatcctttagccagactctgtccctcagtaagagccgctgtggcattgcccatgtactgatggaaatacagcgagctcgtatttactacattaaacttctcaaaatacagtgtattttgacccttatttatataattgctgcccacctttacagctccgccgtttatggactttgctcttgtattccagccctgcttcttggcaaaagacagaccatttttataaatcttatccttcgtgtttccggttgcactaaaattaaaataattataatatccttcgtatccggaatatgtacccgaaataagagggctcgttcccttttgtccctgctcctgctttatacgcgatgctatatggtatgcacttactccactgctctttgccacatccatgaatgtgcttgcataattgattttctcaccattgttggaataggtctttgttccctccataaatgtgccttttactatggacttgacaccttcaagtgcctcattcggactgtatgccagactctgaaactgaaaaatattggtctcatcaagaaaattccttggatccatgagataagcaatataggcactgcttgctgacacccatcccggttcgtactcaacccacgtatttgttgaccagttatatgctccggcagctgtggatttcttggcattgtctgctgatttggataccagattaagtccgtttacactttcattttcaatcaccgtatcccaattcaaacctgtatttacagcctcaaatgtccagcttggatacttattgtgaagagctgtaaggtttggaatatagctgtcaggaaagcctgcattcttcatagccgtgacaaaatcagtattgtctccgctattattgtatgtcacctttatgtatgtactgatagtccagcccgtaaatgccttgccgtttaaagtacccttgacattataccagaccacaccgtttaccctggtctctccaattatgtcaacctgatggttccagttgagtgagacaacctttgtagtgccggatgtgcctgctgcattgcggacatacacattgccacctgtaatcgtacctgtagcatatgctcccgatgcggttgcaagggcaagctgttcctcattattctgctgtatggcatccgcattgccggtgtctgctgaagcatcccctgtctgcgcattgtctgatgcagctgtgccggtacctgctgatacaaaatcagacctgatatagcttacacactcctcgttatttgctgccagattgtactttgccttgtaccacaccttgccgtctgcacctgtggtctgctcaagaataataatatccttgccgtttgaaagcttgtgctccagctcatactctgttcccggtccgcttctcgccgctacccaatatctctcatcacacacaaccttagccgcctgatccgcatagactgctatgctgctgtatggtgccaggtcacatgcggctaatgacaatgtaacgacagaggctgccagaaatttatttatctttatcatcaaatcccatctttcttatgtgcattgtttacattaatccattatccatttaattataatagaatatgacctttgtatcaatgtattcggcagaaatttattatttttttattaattaaaaaaactcccttcaacgtgcagctcatgcttacgtttcagggagttgcctgattcatattctgcttattcttactgtctcctgtagcttttctagctgaacagggattttatcttatcccataaatccatgaaaaagttaccaagcttttcccaaaagcccgggtcatttatcttatcgccaagctttgatgcccagtcctgtgcctggttgatgactgaatcccagtcgatattggcatcctttagcttcattaaaagagatgtaagctttgcaatatcatcatcagaaagcttcaggtcgtaatcctttgcagcctcctttatcgcatcctttatctggctctcatccttgagccttccatcggcaagctgcttctttaggtcagcaatcattgcctcgatatcctgcgaatcgccgtcaatgctcttgttgagctctcctgttgtgacaagctcatccatcgctgcgtctgtcaccttgtcgtcaagcttcttgcctgtcatctcctcgtatgcctttagtgtgcctacaagtgctgccgttccggaaatagggaaaggtcctgcgactatgattttagcatcagctatgcctgctgtggcaagcgcattcttgtacattcctaccgtacagtaattgatattgtgtgtggaaacactaagacccgcaccctttttatcctctgtaatgagtactgaggaaagtgaccttgtgccaatctcgctcttgctgatgtatgaatcgaggtacttgtgctcctcatcattatttacatagaccacatcgtaattgtccagatcagtgagctcgattcccataaatccaagcactgtcgctctctgatccggtgtgaggtctgctccaagacttaagtatggcttatcatttttgctgatggtcaccttgtcgtttgcctcactgccggctgtagttgtgctgtctgcagtactgtctgtgttactcttatcagctgcgtcactgctgtcactgcctgatacatcaacgcttgaaactgtatcagtctgcgtagctgtctctgttgcaaatactgccggattcatcgtaaacagtgtaaccgcagcaagcacgctacatataatactctttgcttttttctttattaatctaatcatttttcctccaatctactgctctatatcatacgaaattgtaaagttgcttccgtcgaagctgacatctgccatgcttccgcataccacaggcatcatcggcgacatatgacctatatccagatccatgatgattggcacattaaactctctaagcagtgatgaaagcgcctgtctgtggtctatgccaaacatttcctctccgaagtgcgccgggcgtccgataagaaagccctttacatttgaaaaccatcctgcatttttcatctgccacatagcccttctcatgcccatcacattaaggtcacaggcctcaaggaaccatatgataccaccatcactgtagcgctcattaaattcccttacatggtcaaacgatgtgccaagcagattgataagacaatccatgcagccaccaagcagcctgcctctcatggtaatcctgctttcctttgccaccgcaggaatagagctgatgcacgacttttcagtcaggttgtagcccacaaacggagcattctcatcctttatcgattccttctcccacatagggtaattggtaaatgaaagcttcctgccacaaagcagattaaatgcatcggtaagtgactcatgccacacctccatgccaaagctgcccgcacacggcccgtaaatacctgctgtatctgcaatagtagcctccaaaaatgtgaaattcgtgttgtcggaatagcccatgtaccatttaggctttgactgcttcacgcgctcaaaatcaatataaggcactacctcgcacatcagctcgccaccaccacaggatataagcacatcactatcagcagaagcatagctctcgttcagctcttctgcgcacttcttaggtgtattgctgatacctatgccactgtcgcacctgcagttaggtccctctatcgtcttataacccatgctgtgaaaccttttaatggcattgtcaaaggcactcctgtacggctctgttgtacagcccatcgaaggcgccacaaagcctattgttcctctatcctttagaaattcagggtatctcatgtttctatcatcctatcactattatttacatatctaagcttctgtctgaagtaaaatatgtaggattttatcatttctgtcaaggtcattttactgtcataattaaatgtcgtcgtgtactgcacatgctgtctgttgcaccagttgtatatatcatgcagacttatcgaatcaacattcttcatattgttcataaacaccttaacctttgaaagctcatcctcactgtcaatgtatagatgaaagatagtattcggacattcaattattatctgctgttctcctatatttttcatcactgtatcctctattgaatgatgtatcctgtgtgattaaaaacattatcgtctgtcacaccgggatgtgagtaataacaaaatatcgtaactgttcagtaccttcacagctaaaaaatatcacataaccatagtactacaccgacgtcacaaaatccagtcatttttgcctgccaattcttactattttattaagaaaaacggtaaatattatacccactcacagtcaaatgccgggataaagctgtcctttgccacgtccccctcctgtataaatgcattcgtgattcctatttcgagggcatagtcaacaagcctttcatactctctccttgtcactgtgcggtttatctcaggataatcctttagtgcaatcggcgtaaactggctcatcatgcttatatatacgtgatcatgatatgtatcatacaggtacttaagtacagcctttgcatcattcacatgtcccggcagtagaagctgtcgcacaataactcccttttgtatgagtcctgtcacatcgtcaatcacgacatccggctgctgcctgaccatctctgaaagcgcctgttttgcaacagacggataatcttttgcccttgaatacattgccgaaagcgtactgtccatatatttaaaatccggaagatacacatccactatgccctcaagcagctttagctctgtcacattttcatatccgctcgtattgtatataataggaagcttcatgccacggctttttgcatcgtttaccgcccacactatatcagggatatactgccccggtgtgaccagattgatattatttgcgcctttgtcagcaagttccataaagatatcactcagacgctctttactgattacctttccctcttttccgtcagaaatctccctgttctggcagaacacgcagtgcaggctgcagcctgagaaaaaaactgccccgcttcctctttttcctgatatgcacggctcctcccagtaatgaagagctgcgcgcgccacctttatttcagctgaaacgccacatacacctgtttgtcctatacctctgtttatgccacattttctgggacacaataagcaattttcgtatttattcatatttttcattttaacccttgctaaaaataatgtttgatactacaatctatatgattatgcggtgcatatgccatgcgccttcagtagtcattttaaaattataccataactattcttacagaagagaatagttaaaatacacaataaggagattacaatgaatcagtcaaactgtatcgtcgcccagtcaggcggcccaactgttgcaatcaacgcaagccttgcaggagtcatcgcaggagtaaaaagctctgagaaatacgatatctgctatggcgccgtaaacggaatactcggcatattaaatgagaattatctcaatctgtcagatatttttgcagatgatgctaatcttgaaaagcttaagaccacacctgcgatgtatcttggctcatgccgccacaagctccctgattacaaggatgatgattcaccatatgtatacatcttccaccagttcgataagctttctataaaagctttcttttacatcggtggaaatgattcaatggataccgtattaaagttatccgattatgcaaaaaaaatcaacagtgatgtgaaaattataggaattccaaaaaccatcgacaatgatctgtgcatgacagaccatactccgggatttggctctgcagccaaatatatcgcatcaagcatgcttgagatagcccatgacacctttatctatgctgttaagagtgttacaatcgttgaaatcatgggacgtgacgcaggatggctcactgccgcttccgctctcgcacgtaatgagtacaatacagcgcctcagttcatatatctgcctgaggtggattttgacaaggacaaatttgttgccgatataaaagaagcccttacgcacactaacaatgtaatagttgccgtatccgaaggaatacatgacgcagacggctcatacattacatcatcaaaggccgcatgtgaccagttcggacaccagcagctaagcggtgccggaaaagctcttgagttcatcgtaaaggaaaacatcggtgtcaaggtgcgctctgtagaggtaaatgtgctccagcgctgtgcctcacaccttgcatcattaaccgatatcgaggaatcttttgctcagggtaaaaagggtgtcactattgcagcagagggtgtgaccgcatcaatggtatgcttgaagcgcatctcaaataatccttatcaggtggaatacacatattctgctatcaaggatatcgcaaacgaggccaagtctgtgccaagagattggatcaatgatgcgggcaatgatgtgaagcctgaacttatcgaatacttaaaaccacttattcagggagaaaccgctgtagcctacaagaatggtctgcctgactatatggatgtgtcacatcttcacaaatgtaactgattttagctgccgcctaccccccggtgtaggcagcaacagcatatctccaaggaggtcgatttacatgaagaaaaaagtgcttataacctgcgccgttgtgcttggtgtgcttttggctgtttatcttggctttgccttttattttagcagccactatctgttcaacacaaagattaactctgtaaaatacgcaggtaaaactgcaaaagaggcattagaaaaaaatacagccctaagccgcgattatctgctcacaatcactgacagaaaaggcaacagcttttcacttaagggacctgatttttcctatgaatatgtctcaaacggtgatgaggagcaaatcctaaaaaggcagaatgcttttacatggcctgtcagtctcttcaaagctcaaaactatactctaaagggttcatccaaatataacgatgccgctttggcggaaaagctcaaggctcttgatattttcagtgatgactacattgaaaatccggaggatgcccatatcgagataaaagacggcgaatacaatgtgattgaagagaaaaaaggctgcaagccgatatatgacagcatccttgccgaggtaaaggacgccctggacaacgagcttccaaagcttagcttaagtgatgactgttatgaagctccaaaaatcacaaaggaaagcgatacaatcaaaaatgaaaaagaagccctcgacaaatacactgcttcaaccgtcacatacaaaattgaaggtgccgatgagaaacttgactcagccaaaatccttgatatgctaagcatctcagatgacggcagcgtgagcatagatgatgccaaggtcactaaatatgtccagcagcttgcttccaagtataacaccttcggacgcaagcgctcgttcaaaacatcgtccggtgacactattgaaataggtggtggagactacggatgggtagtcagcaagaaaaatgagaaagcccagctcctttcagatttagagggaggcaagccagtggaaagagagcctgtttacgagcagacagcactctaccgaggcgctgacgacataggtaatacatacatagagattgactacacaaagcagcacatgtggtattacaaggatggtgctctccagatggagtctgatttcgtatcaggtaatctcgcccgtcagaatggttccgtagatggtgtatacaagattgtttacaagcagagaaatgctactcttgtcggcgagggatactcttctcctgtcagctattttatgccgtttgcctacaatataggtatccatgatgccagctggcgtgataccttcggaggaaccatttacaaaacctcgggctcacacggatgtatcaatgtgcctcctgcttttgcagagcagctgttcaatgctgtggataagggcactcctgttgttgcctactacagagaggctgtcactctgacaaacaatgctgcaaagatgtccaatgcatactcgtatgtggctcctgatgctgcacaataattaataatattggcccgcccggcagaggtgctcccgacgagctaacgctacgcagctaaggtactgcgctagtcgctctttcgggagcacctctgccgggcgggccaatccccatgtgccggtcgctttttcttactctttcgctatattcatgcgattcttccatctgaaagtgtgttaaaatctgcttacattgaagtattttccactactccagtaacaaaatgtcaatagttgtttaatcattgcctgccactttatcaagaagtcttgcggaagtccgctttgcttcccttgtagcatggacatagacattcatggtggtactcacgtctgagtgtcctaacagttcctgcacatccttaggctgagccccgttggataagaggtttgtcgtgtaggtatgccttaatgtgtggaaatggaaaccttcaagctccggcacattttctgtcattcccaaatggtaatactcgtaatgcacccgattcttttccattacctctctgtaaaaattccgctgataaagttctccatactgaaaacgatttacttactaagaaaaaagagcttgaaagcaagattgccaccaaagaggaagagatccgaactctcaaagccagattatccaatatcgtcagacagcatgaatttgcaacagtacaagacttctacacagcattctatactgcacagcgtgcctttgacgcatatcagaaagaacgttctaagtgggaagaagcatacggagagaaagttactccaaagttcgaaaccatacacgacaaaataaaaaggtatcaggaaaagtctgacaaccagaacgccaatcgaccttatcaaagcaaagataaaggggcgagataatcgcccctcaatttcattgcttaattttttcaaaaatgaagttcagaacactcatcatcaagaaatcacactaaacttccattattgaaatcaatttgattaattgctatagtaatcagctcttcaatatttgatagctatataattttttcatattttcactttttcttctctcagcctcttccagcgcctcattatataaactcttgtcagaatatactttatcccgaggatatacaatactttcgataataccatgaaacaaatcatcataagccatttctttcgtatagccatcaccaacatttcctgcatcaatttgtgcgtataattcatccagatgctgctggaaatacgtttgaaaatcatcatggttatctgttttaatcaagacaagagattccccttcaaaagtatcacatgcgcgcaatttattaatcgaatattcctttaaaaaatcaataaaagaatctaaatcataaactcgattgaatataggcatcaaacgttccttcacatataaagccgtcgctgaaataatctcttccattgtatcttcggtatattcaaaacttactcttgcttcatttcgtggaaggaatgaatttaaatcctgtccagcatacaatattgattttttatcgatagaagaatgataggtagaaataattcctgcagtaaggaaaaatccttttgcccctttattccatgccggagctgtttttactccaaaaaaagccatcaaatcttcgttgagcattttaacaaaaacattcaattttgagcaatatcgaaaaccctctgtttgaaatgtttcaccaaaaataagtttaaactgtgaattaaacgacataaaaaatctcctttgttatagtccaaacatcaacctgtatgcaagatagaatgatgcggcatcatctgcaattccgccaccacctgtaatcacatcttctgcaagtgttcctccaacgataagaacagctgctacagttcctgcgctcccccttttctatcaaattgacttgtacaaaaacactactattgtatgatataattcgttatatttcaataattttccacctcttttatatcttttgcacttttgcaaaaaacgcagtaacatcgtcattataaccgacaatgtattaaaagcatttcatccagttacaattgccatttttataattttttattagttgccgccagattttctttcacttgtattttcccttatgagggttcataatcaagggtaaaatgatataacacgatacaagatgtgatggagagaacaccaatgaaaagtttagcattttcaatggattaacgagttttccataacaaaatataacagttattaaatgctatagatttcgtcatttgagaactggggtttatcaacctttcctcttattattaaaatcgcttactccaaacaaagcaaatacgaaagagacaataataattgaaatagtagtcgctgaaatggactgcatgaaatagtctacgattctcaatcccataaatgtcgcaaatgtatctaacaaaagatacataataacagcagattgtttatctatcttttcaagcataagcaatgcttttggtaacacatcagcaagcaaactaaatgggtatgaaataattgttgcaattataaagaatagaataatgcttccaacagacgtatagtaaaaaccaaataatctcattatagctcgattatccgaaaaatctcggaagccttaattttactatatttgttatcagaaggttgttctgctcgcaacgctcacagaacaactttctcactaacttcgcgcttacgcactcattaagtgttcaatgattactcgatacctgtagcaacacgtccagattctactgtacgtccaccatcacggactttggtttcgtgatattcgattatttgaaactaatttgtgcggttctgttgtctaaagtagcttatttttgctgaggaattagtgctttataaaaatcttgtagccaaaatgtagccaattaacgtttagataagcacaggcaaatgaatttcaataattctttcaaaataacataatcactttaatataaataagttatgttattttaaaatatatctgccttcttctttatatatttcttgcttaccgtcaacacaaaatgctggtctgataccattcatatcgtatgcattcgtgcttccaatttcaccttccggtcctactgcatatacacaagaatcatatgtagaatccgcacttcttaaccaccaacttacagtaaactttccattattcgtagtagcaaaacgattcttattatctttaaaatacaacaatggcaccccttcaactccgacatgcccattttttttatatccaagttcagtaaaagacaacaaaaacacttttcttacaatagttatcacgctatcatctatttgattcaagcatcgttcatctaaaatctctatttccgaatcttgaattaagcaacgagtttgaataggtaaattatcaaaaaactctcccattaagtaattatcaatttcactttcttcatagtaagccgaataatcactaactcttctattctctggaagaatttcttttcttaacaaaagtgttttaccattataatcattagttaatacaatatatggaacaaatcctgttttttcttcaatatatatgattggttcaattttacatttttcagaatatgccaaatcacttattgtattatattcctcggttactgcttgtcttttactacaagcatttaatagaactccaagaacaattgctaatactactactttatacttttttctgaacacttatgtggctccttaatttctctgctttttacgtcttatttttgtaaatgccatacacatcactatacttaccatgattacagccattagactacaaaatccaactgcagattcgtctcctgttgaaacagattctatcttttctcctccattttcatttattcccgaaccagaattattacctgtattattatcttttcccgaatcaggattttctgggttcgctggattttctaggttcgctgattctccatctttttcaaattttgcaactaaaagggtatctttttctacacaaaaacgatattgtgtttcttgcgaaattaatttatcattctcataccaaccaacaaattggtaaccttctttagcaaccgcttcaacttttgcaaaatttccttcttgtctaattccttgacctatagcaataccatgttcatccgaatcaacttctactgtcaccatataataagcagattttgcatcttcaccacttaaattttgatcaggattaatttctttaccatcaggtgacttcaactcatactctgtagttgaaccttctatttcattattttgttcatcatctacataagcaggaacaactgcattaaacacatcatttttattcaaatttatatctttataattaacgactcttgtaatatcacctgctgtagaagaaaattcatttatcgagtaattcattgttccgttatctgtagctgttaattttatctgatacgatgcatttgttggaagataaactattttctcatcatcttcattcaaacttgccacaacagtcccatttttaatttcctgtggtatatcatctacaatccttgcttgtaatatattttcactatcatatacttctacatctatcggacaattaatatgtataacacgatagttaccatttccgtcaaactctgttggtgaagatgtatagttctcatcttgtgacattaaccatgccatacatcgtagcctttagtaacataatactctgcaatataccgactaacaaataccgttccacctgttacaagtatctttttcatatctgcattctccttcaacttcaaattcgtcacatcactttcattggaactattttcccaaattagaacattgtaatttaattgcctgtatagaagtgcgctcttagctttgctaaaagaattatgccgtatccggcgtgttatcttttttcgatttcttctactttcttctgataaagtttcatcaattctgcaacacaggctgcttcgcttttatacgcttcactgccttttgtaaattcgtatgcctgcatgactgccatatcattctggtgatgtgcttttctcaactccggcggcttatgccccgtatttctatagccctatgctatgcaaactggctattgtagaggtttgcataaaatccatcggctgcaagcagactctcatgattgccctgctctataatctttccatctttcataacaaggataatatccgcttcccttatggtagacagacgatgagccactataaagcttgtcctgccctgcatcatggtaagaaatgccttctgaatcttaatctctgtacgtgtatcaatcgatgatgttgcctcatccaatatcagcataggcggtaagcagagcataactcttgtgatgcataaaagctgcttctgcccctgtgacaggctgccaccgtcctcaccgatttcagtgtcgtaacccttcggcagacgtctgataaagctatgggcatgggatgcctttgctgctgcaatgatttcctcatctgtggcatcaggctttcccattatgatattgtcacggattgtacccttcttgagccatgtctcctgaagcaccataccatagttgtcacgaagactctctcgtgtgatttttctgatatcgtgtccgcttaccttaattgttccactgtttacatcgtaaaacctcataagcagattgataattgtcgtctttccacagcctgtcggtcctacgatagccactcgctgtcctggctttacatggagattgaaatcctcgataagctttttatccggcacatatgagaaataaacgtcctcgatgtccacgcgtccgtctgcctcaccaagtgttaccgcatccgaagcatccggtatctccttttcctcttcaataagctcaaaaatacgcgcagcacaggcaagtgcgttctgaagctctgtgatgacacctgatatctcgttgaacggcttggtgtactggttggcatatgataagaagcatgaaagctgtccaactgtgattccgccggtgagtgcactcatagcgccaaagattccgactccggcatacacgagactgttcacaaaacgtgtactcggatttgtaagacttgagaaaaatgttgccctcagtgagcatttctgtaatctgtcatttatctcgtcaaactgctcaagagcctcatcctcatggttgaaagcctgtactaccttttcatttcctactatctcatcgatgagtgatgtctgctctccccttgttcttgtctgtagctggaacatggaatatgtctttttagtgataaagcttgccacaaaaagcgacagaggtgtgatgagcactacaatgcatgatatcttcacatctattgtaagcatgaaaataagcgtgcctgctattgttgcaattcctgtaaagagctgtgtgaagcccatcaaaagtccctctgaaaatgtatctacatcggcgatgatacggctgaccatatcaccgtgtgagtggctgtcaatatatgaaagtggcattttttcaatgtttaaaaatgcatcacgccttatatccctcactatgttgtaggtcatcctgttgttgcagatatttgtaagccactgggctgctgccgctatgacgactattattgctgctcttgtgaggatggctgtcatagccgtaaaatcaacctttccttttcctacaatcaaatcaattgcgcgtcctgtgagaattggaaaatagagcgtaagcgccactgtaacaacagacagggcaagtgaaattacaagcaaaggaatatatctcttcatgtagcttaataccttgcggattgtgcctgctttattcatcttcgcattatccatagccatactctacacctccttttgtctggtcatatccgactcttttttaaactgtgaatcatatatctctttgtaggtctcgcatgtctcaagcagcttctcatgaggtccgaagccaaccatctgtccgtcgtcgagtactatgatattgtccgcaaactggatagatgaggtacgctgtgacactataaatattgtcttgtcaccatgcatgccctttaatgccgcgcgaagactcgcatctgtagcaaaatcaagtgccgatgcactgtcgtcaagtatcagtatgtcaggatcctttacaaccgctctggcaattgtaagacgctgcttctgaccgcctgataagttcttgccgccctgctctatcatgtagtcaaggcctccctctttgccctttacaacctctgtcgcctgtgctatatcgagtgccttccacatttcctcctctgtggcatcatttttgccccagcgcaggttgtcggctatcgttcctgcaaaaagcactgccttttgcattacaacaccgattttgtctcgaagctgcactgcatcgtagtcatttatatcatttccctgaatccttatagtaccctttgtggcatcataaaacctcgggataaggtttacaaggcttgattttcctgaacctgtaccaccgatgattccgattgtctgccccttttgcactgtaaagcttatatctgtgagtgtctcatcggccgctccctcataggtcatgcagacatgatcaaactcaacctcaggtgcgccatcctttgcaccaatgagcttaggatttttctcaggaagctttgatggaatagaaagcacatccgctatacgattaccgcacgccactgcctttgtcatctgtacgatgaggtttgcaagctttatcagctcgacaagtatctgtgacatgtagtttacaagtgccacaacctcaccctgtgtgaggattcctgcgtatacctgcttgccgcctgatacgataactgcgattgttgcgacatttataatgataaatgtcagaggattggtgagtgctgagattcgtcctacaacctgctgcatattggttaaaaactcgttgtccctgttgaagctgtcaatctcatcattttgcttattgaaagctcttataaccctggttccctctaaattctccctggtgtgtgaaagcactgtgtcaagagagctctgcacctttttgtaaagcggaaggcttgcagccataactgagaataccactattgaaagcaaaggtatagtaactacaaaaaccattgccgctcttacatttactgtaaaagccatcgtcatagctccgaatacaataaatggcgagcgaaggaagagtcgaagcaccagattgactcctgactgcacctggtttatatcgcttgtcatcctcgtgataagtgtcgatgtgcccaccgtatccatctttgagaatgacagtgactctatcttttcaaacaatatatggcgaagctttgtggaaaaaccaactgctgcctttgccgcaaaatactgtgctgtgaccgaacttaccaaaccaactgccgcaagcagcaccagcacacctcccatcttccatatatatggcttgtccgaagccgtaattccgttatcaatgattgccgccatgacaagcggtactataagctcaaaggatgcttccagcagcttaaataacggagcacagatgcattcctttttgtactcctttaaatattttaatatctgtttcatcttttcccctttcagattttatgtcgccgattacagcttcactattatagatgatttttctcatatatacaagaaaaacgatacactaaaaaaccagtaccatgcggtactggtttcatatatcagctcttatgtatatgcttcttgattgcttcaaagctctcaggactgatgacatgctctatacggcatgcgtcctctgctgcaatctccttatcaacaccaagcttctcaagacactctgacaaaagctcatgtctttcgtatatcatctctgctatctgtcttcctgactctgtgagtgtgataaatcctgcatcacttactgtgatattgttcttctctctaaggtttttcatggctatactcacgctggatttcttaaatccaagctcatttgctatatcaactgagcgtaccacaggaagcttcttgctgagaataagtatggtctctaaatagttttctgatgattcattgtttcgcatttcgaatacccccgtgagtttattttcgttcgttttaattcagttatattattataacatacattttattgtttgcaaaacttttcttttgatttgtacgtgatttataaaaatctaaaaaaatatcaaaaccccatatttgttattgacttctaattcatgttagtgtatactaactatcgaatcagaaaacaaacgtatgcatgatatatttctaaatcttgtatgccataaatgtttaattataccagataagaccggccgatcaccggtcttatttattttaaaaaatgtacatattcagcttaaacgagagctctttttaacctttccaacccttccataagcactgaaccggggcatgcaatgttcaatcgcacaaagtaacggccattgcctccaaactcagctccctccgacagataaaggcctgtcttttcacgaatcatctgcgtaaatgccacagaatcatctgtgagtgcactgcagtcaagccacatgaggtatgtcgcatcggcatccactacatgtatctgcggcaggttttctgccatgaagtcacagactgttttgcggttttcccagagatattttctgagctcctcaagccacggctcaccctttgtgaatgccgcaactgctgccgtgatggcaaatgcgtttggctccgccacctcgtctgtatttaatgcgcgccatactttgtggcgcaaaaatttatttggcaccatcactgccgcagtctgtaagcctgccatattaaagcacttggtcggagcaatacaggtgatgcttatatcagcgcagtcctctgatgctgccgcaaacggcacgtatgattttcccggtgctgtgatgtcgcagtgtatctcgtctgatatgaccgtcacattgtacttcctgcagagtgcacctattttcgcaagctcatcctttgtccagatgataccgcacggattgtgagggttgcaaaatatcataagcgaggtctgtggattggaaaggtcatgctccaacctgtcatagtccacaaaatatctgccgttttcgtatccaagcgggctttcctgcacatttacgccgttattaaatatggaattaaaaaatatattgtataccggtgtcatgataagcacattttcaccgggtgttgtgagctttcgcactgtagatgatatggccggtacgacccctgtgcaaaaaatcaggctgtctctttcgattttaagcccatggcgtctgtcccaccacgaaatatacgcatcattccactcatccggaatgatggaatagccaaacactccgtgagaaacacgctctgatattgcctctattatctgtggagctgtcttaaaatccatatctgctacccacatcgggagctcattttctgccacatcccactttagtgagcctgtatttcttctgtctacaacggtgtcaaaatcatacatagattattttccctcacatattatcttagtctttgatgggtcaactctgtccctttcgatagtcagtgtgccaatctcttttgcccttatcactccgcttgtcggatttaaaacactatccactttactgcaaatctctgcatctaccgaagaatactcaaatgccaatgtagtgtttatgagcttacagtttttcataacgaggttgtcgatgtagcaaagcccctgcaagctttcgattgtgcagtttataagtgtcagattctttgcgttccagccaaggtattcacctgtaataaatgaatcatagactgtgacattttccgtattccagaaggcatcctttgagataagctttgaatcgtgcacctctacatttcttgagccgtcaaacgaatagttgccgaccagctggaaattcttcatgataagattatttgtattcatgccaaaataatctccctttgccgaaacattctcgatatcgacatgatcacagctccagagggtctcctgggcatttggaaatgtcacatttttaagctttaggttattgcatcgcctgaagttcttaggtgcctcaactattgaatcagtgacagagatattgtctgtataccagacacccgcacgcgccatgtcaaaccatgtacagtcctttacagctatgtcactacagtaccatagcggatatttccatctaaaaaaacagcctgtcaggctaatgccatggctctccttaagaggtgactctccgtcatcaaaaattgtatcatatatatccaggtcgttgcttgcaaacagggctctttcgcctgtcagaaactcctgatggatttgttttctttcgctcattatatatactcctttttcccggtaattctaaataattatctgccataaaatcaaataaccgccgagcacataatatatgcatcccgacagttatcattataccccaaaccctactgaatttatagtattttatataagtttaatattacaaaattaatattaagagcctgatatttacagctcaagcccgtcaagtatgctcttaagtgcatcagcagactccttgagctttaaagcttcctcaccgtttaactcgatcgggatatcgctctccactccgtttgctccaacgattgcaggcattgagagaaccacaccgtcgatgccgtactgtccgtgcatcatgtgtgaaacaggaagaatagacttctcatcacgcatgattacctcgcagatacgtctgaccgacatagcgataccataatatgtcgcatgctttcggttgattatctcgtaagcactgttctttacgtttgcagcgatttcctctgtattctccttgtgcttgtagtgacctctcatctcgcacatcttgtgaagctccactccggaaacattggctgatgaccatgcaaccacctcactgtctccatgctcacctactataaatgcatgtacgcttcggctgtccacctcaagatgctctccaagcgcgtacttaagtcttgcactgtcaagcacggtacctgaaccgatgacacgctcctcaggaagtcctgaaagcttctgtgccacctgtgttaaaatatctacaggatttgcaacgataagtaagattccaccgaaatttctctttgcaatctccggaatgatgctcttgaagattgcaacatttttatttaccagatcaagtcttgtctcgcccggcttttggcctgcacctgcagaaacaacaatgatagcagcatctgccacatcatcataaccacctgcatatatcttcataggtctggcaaaaggaataccgtggcttatatccatcgcctctccctcagccttgtccttatcagcgtcaatgagaactatctcagaaaaaagaccgctctgcataagtgcaaaaactgatgccgaaccaacgaatccacatccgatcatgacagcctttcttgggtttgtcttaacaactgcgctagttttattgctcatgtacgttcctctctttcttaaactataattcaaatagttgctttttattataactattcatcccaaacacaaattctcaatatctgctttgttatcagtagttctgaataattatcttttatttatattatacccgcattgtacatataatccgttgtaaaaacaacaaattacttgataaaatacaatcaatagcccattgttcccatttttatacaattttaatgcagatttttacataaaaagtgcagtactaaaaagcaaaccggaccaatacagctgaatgaattgtcatttggcatattgatccggttatattaaaatgctgtatccgcttattttgtgcttgaatttctgtactcaagcggtgtcattccatacagtttcttgaactgtctgttaaaatgctccacattctgatatcctgcctcgattgcgatattctcaacagttgtaatgctgtttctaagcagtgtgcgtgcctttttcatcttggcattggtgaccagctctccgaaggtcttgcctgacttctcctttatgtactttgagatataaggctctgtcagattgaactgtgcagccatatctgcaagcgataccgtcttgtagttggcctggatgaagttaagcatggcgatataacgctcatccttcacatggctgtcagcctttgtggcaaggtaatggtttaccgcaacaacaagagctccgattgatgccttgatgatatcctcatccacacctgcgccccagaacatcttgccgtcaactgtgatacccacgtatgccatagcctttgatgaagagccgtgtgaaagcgcatgctcctcgtatacggtaagctcaaagctgatgtcaaaatactgctttattatattgctgactgcatcgagacggccgtttccgttggcatctacctttctggtgctgtcattgtgcaaaataactgcctctgcgaaaataccgttcacctgcttaaagtggcactccggtatagtaaaatatggatggaaatccacataattgtctgtaaagatgctgtgtacccaatcaggtgaaagctccttgtgctcctcgtcagatacctgcttgaccatgtatccgacctgctctctcatctgctgtggcacattgataccgaagctctgcttaaggatataagccactccgccctttcctgactggctgttgatacggataacatcagcctcgtatgtcctgccgacatcctttggatctataggcagatatggaactgtccacttatcaagcttcttttcctctctccatgccatgccctttgaaatagcatcctgatgagagcctgaaaatgcagagaatacgaggtctcccgcatatggctgtctctcgcctaccttcattctggtatatgtctcatacttctccctgatctcaggcagatttgaaaaatcaagctgcggatccactccgtgtgagtagagattcatagcaagtgtcacgatatcgacatttcctgttctctcaccgtttccaaacagtgtaccctctatctcctcagctcctgcaagcacgccaagctctgatgtggcaacaccgcagcctctgtcattatgaggatgtaagcacagcactactccgtctctgtacttaagatgcttgtcgatatactctatctgtgtggcaaaaacatgtggcatagcattctctactgtggtagggatattgataatggccttgttatcagcctttggctgccatacatcaagcactgcgttgcacacatcaaccgcataatccacctcagtgcccgaaaagctctccggtgaatactggaagcggaaattaccgtcagtcgcagccgcaaggtctctgagtaagatggcgccgtcaaccgcaagctgctttatctcttcctttgacttcttaaacacctgctcacgctgtgcaacagatgtggaattgtacagatgtacaaccgctctcggtgctccctcaagtgccttgaaggtcttcttgatgatatgctctctggcctgtgtcagcacatgtatagtgacatcatccggaatcatatccctctcaataagagctcttgtaaaattgaactctgtctcagaggctgccgggaaacctacctcgatttccttaaagcctatatctacaagcatcttaaagaagtcaagcttctcctcaaggctcatcggctctataagagcctggttgccatcacgtaaatcaaccgaacaccacagtggtgctttatctatataatccttcttaacccagtcataagtgcattcaggaggcagaaaataactgcgctcgtatttttcatatcctttcatcttaaaacctcttttcgtttgaactgatataattgtaacacataagcgcagttattggaatgattatatttaatcactttggttgatgtaatttaattttttataaaaatataatcaactttattgattttgattattctaatcagatattctggtcaaaatatctgactaatcctctctcttattgccccagaaaaacaatgcaactgttccgggaccggtgtggcttcctatagtcgtaccgatatcatttatctctaccttgcccttcatcttaggaaaagcagcctctatcagatcagctacggctctagcatcctcatagcatgcggaatttgatatgtataccttatctgaataattggcaccgtccttgcagagcgcctgcatcttcacaagcatctcctttatcgccttctttttggtgcggattttctcacgcacaataagctttccctcattgctcacattcatgaaagggcagatattcagcacatttcccacgaagcccgcggtctttgagatacggcctcccctgataaaaaatgtaaggtctgatgagaagaaccagtgattcacctcaagtctgtgctccatggtccaattagccagtgtatcaatatccatgccactatccctaaggtcagcaagcttatccatcaaaagtccaaagccagacgatgctgccagagaatcaatcacatatatcttcctgtcagggtactcctcctcgagagcctcctttgcaagccttgccgagttaactgtacctgatataccggagcttagtgcgcagtgaagcacatcatatccctcatccaggaactgcctgaagtactccatgtactcctcctgattgatctgcgaggtctttgtcatggcaccggcttccattgccttgtagaaatccggcagtggcatggactgtcccagatcatccatatactctttgccgtcgagctcatagtgaaagcacgcgtacttaatattcctatcaagcatatgctctttggtaagatctgctgttgaacagcagctaatcacataatttgacatattattttcctttattataaaaatgatatgagggtcataaggtattttgcccctcatttatgattaatctttgtagttattcagaattgtatctaatcattatatgtagtcagatacatatggtatctcatgatataaaatatcgtcaagctttgcaacagcatcatacgtagtttgtattttacccatctgcaaaagcttctcagcactcttgtagcctaaaagcagtgtggtaaacgtgccaatagacatgcttaggtgatactgtggatttttgtcggtgagagcacagtgccctttctcaaaatcaatgacaaatgtgccattgttccacggaagaagttcatctgctatctcaaagctaaaacagccgcccgggccatccgggtcacagttatactgtgatataaactgcgccacgtcgatgattctgcccatggcgtatggtcttattgtctcctttatatcactgtcatcgagctcaaaagcgatgggctcgctgtaatagttgttgcctctgacctcatcaatcatggaatcgtgcgcatgaatgtactcccacagaccaagctgcgcctcacggtttaagtagatgagctccttgatgtgcatgacatcggagctgataagatacaccatatagccacacggttcgtcatcctcgttatagtagatggcgaccatcgtatcgtcctcatcccagcggaagtactcctcccaagccagattgtttctgtacagacagccgtgagtcttcgcggcaaagtgagtatgaagcttcttaaactgctcgtcatcccactgcacacggcgcacatagccgggctccttaagctttgtaggaatctgtctgtcctttatcacatatgtcatcttgtttgagataatctcccagccaagccctctgtaaagaggtatggagtatggatacaaaagggcaaacgacttgttgctatctcgcatcctcgtaagactctttctcataagctttttcatgagaccacggccggtgtactcaggatacgtgcacacacttgtgacaaagcctacctcgtagcgctcaccatatatattcatatcgagcggatatacagcaaactgagccacaagctcctcttttttgtctatgatattcaagcagccaagcacatcggctctctcaagcaccggaaacttcgactgcttgatttcatcatccttccaaccggtctcggcaagatctgcctctgttacctgaaaagcataacgaagcagtgcattgtattcctccgcatcgtcctttgtcaatactcttatcttaaattcatctgatttaaaagaatgcatagtgtcctttctcgcctgtctttactgtatacatcagattgtccgccttcttaatcagctcagtaatctgactctcacttgtgacatttctctcatatgaaattccaatagaacaggtgatattcttctcctctttaaactccacgtcatgattcaggtatttctttatctggcttctgaagccatcagcctctgcaatcctcgcatagatgtccttcgcaatattctcaagctcgtatctggcacaggactcaataactatgataaactcatcaccgccatatctgctcacaaagcctctgtccttagcaactttcctgaacacaaaggccatctccttaagtatcagatctcctacatcatgaccatacgtatcattataatgcttgaagttgtccaggtcaataaacataagccccacatccattccaccggatgtaacacttatgcgcttttcaagcttttcaatctcctgatacatacctgctctgttatagataccggtaagcatgtcagtgacagctgcctgcttcagcctcttgttcatctcattggccttctcatttgcctcaatacgggcaatggaatactcaagctctctgaataacagcttgaaaatgctcagatcatcctcattgagcatgtatcgctcgattgagccatgccagttgtccttcatgcgcacatatgctatgagtacacttgaaagtgcatcattcttgataaaaggcactgcgacaaatgagcatacatcatccacgccgaaatacgagatgacattttcatactcgtagaagccctctgcaatctttgatgtggcaatgccctccggatagtctatcatgatatcacatatgccctttataacctcatctgtcatatcacagcccgtatcattataaagcacctgtggctccttcgcgtgcagatctatgatcagcgcacagtcaagactgaaatgattgatgaaattgctcatggcattttcaatcatggtgtccttcttctggtcattgacatcgataatggtctgccatatggaaataaactccatctgacgctttgagccctgataatccttttcgagcccatgctgctttacaagcatattaatctgccgctcattgatatggccatcactcagtgactctaggttgatattttttaacatgtcaagcggagctgcctctgctatttcatgcatccttttattgtgtgcctctaaaagtattctctcatgctctataagctcatttttgccgagcagctcaaacagcttcatcctgctttccctgtatatcgaatatgcaaaaaattcgtttccctccgcattaacgagatatctctccgcatcctcaaaacgtaaaaaggcttcttccttttcaccatcgtgccacaagagcatggctgatgcaaaggagtaaaggaacatctcatcatcgcatctggaatagtcatggactgtctcagttcttgtggtgtcaattactctgtagatgacataattaagaaactgcttgcagctgagcagatagcgctcacagctgaatctgtcacccgaaaatatagatgcaagcgcaagaagcgcatataccttactcgtgttgcacactcttaagctgtttagatgaagctttataatagtcttcatggcaactaaaagtgcatggacagcctccttataattgccctgcatgatatagttaagagacttgttataatacacctcagctatatcctccggcatcttcaggtaatataacatattgattgcagcattgtaataattgtcaaccagctcatttttacccatggcacttaaattgtagcctatagacgtaagcactctcgcaacatatatattgccgtgccccttcatgaactcgtatgtacggataacatataaaaaggctatctcattgagaccgcttgtgctggcaagcataatagtcttctgatatgcatcatacacaagctgctcatttcctatctccttcgcaagctcaagccccttcgtaaaatgctttagtaatgattcatcataaaaggactgcttcaccacatcccggctattgtcgtatgcgtaaatatatatatgtgccaaatgattcctgtagccgtgctttatgagcttttctataatttcatcactgacaggtatatcctgtacacagaagaatatattgtaccagcctgacatctttatcatgactgacaaaagctctgccttaaatatcagtgtgtcatcctctgccaaaactgcatagtcataggcactctttgcactgtttccggccttctcaagcttgccctgatacatatagcaggtgcccttcatgaaataatacagcgaaagataatgctcactgtcattttccggtatcagcgccttgtattcattcgtgagctcaatcgctttggacatctctccaagtaaaacagacgtccttgcatagaccatataaaagcggcgcaggcttttctcatcaatccatgcatcctcaaacttaagcttatgctctataatgcggcagcctctccttgcctgctcaaaatccagaaactccatgatatttgatgcttcctggatgctctgctcaaagttcatagtgatatacagctcatcatcatttgtagtttttacgttatttttaagcggtccggcactgcctatatagtatatggcgctcctgtcctcaagcgactcaactatacgatcccacacctcaacagtactgtcagtacccttgactatggcattgacacctaacacgataccgatattggcgcatggattgtcaatcagatacttgatggtctcaattgaactcttagacgccatctggaatctgtttatcacaatcatcaaaggcttcacctcagaaagcttcttgagcatgtcagctatggccatcgtcatgcgtctctgctcatatgccacctcatttaacagcactgtctcctctctgaagcactcacctgtctcataatagctgtttaacacctgtctgtgcagatagtacacaccgcactccttctggaaatcatcaaagcttccgcctataaagcgcctgtgcatattgcatatgatgtccaaaaatggctcataagctccgaccagcgtattgtaagagaactcactgtatgcaaaaaagacgttatcctcattgctttgataacgtcttataacctcaagattttcaatcgaaaaatcattgctataattcgccattacgatatttcgagtctcttttcctatgcgattgtaaatctgctcgattaccccgctataatacttctctatcatctaattaccccatcatgttccaaagccgacacagtgtatatcaatcctcctgtaatcaggcttttccgaaataatcctaaaaccatagtagaccaaaactcctaaaaagtcaatcttttgactcaataatgataaattttcctctatggatatcaatcagtgcatgatcatcgactatttcattggatatgccaagcgatgtaaacctgtcaaaggaataatcagtaacaggatacttaaagcccttaaggcttacctcattgtcgtctgtcagtgctataagagatacaaacctgccatactgtgctgatttttcaatggttaccggcttatctgccatccttatgcggttgtttgtatcgataatgctgatatcagttccactttccaggcctattcccaaaagtgaaatatttccaagcacatggtctattctgctgcctgttgctccaagcagcactatgcttcgtgctccctcgcttattgccagtcttatggcatactctgtatcggtatcatcctttatgggattgagcctgcgtatctcagtctgtccctttctctcaaaatactccaatgcatttgtcgtagtcgaatcgaaatcacctacaattatatcaggtgtgacaccgttttcgtacagaaaatccattccgctgtcagccgcaatgatagcatctattccgtcagtctttatctcgtttaagccaaattccttatctatttttccaccacatacaatcaaataccgcattttatccaccctctccttaataacatatccacatttgcttaagccccggaagcatttccgttttaacctgcatctgttacatcatgatattcagaaaaccctttacattttcttctatatctccgctaaacaccgcacttcccgcaacaatgatattggctcctgccgcaagcagtgtctcaacattctccagattgacaccaccgtccacctctatatcagccttgtttgcggttttctcaagaagcgcctttaggtcgcgcaccttgtctacagtgtacggaataagcttttgtcctccaaagcccggatttaccgtcatgataagcaccatatccaccttagggagcacatactctatagcagaaagcggagtagccggatttaatgctacacctgccagtatgcccttttcctttattgcctcgattgttctgtcaagatgcttgcatgcctccgcatggactgtgatgatgtcagcgcctgccgccgcaaaatcatctatgtatctgaccggctcatctatcatcagatgcacatcaaacatgcgctctgtgcactttctgattgtctttatgaccggcagtcctattgatatgcttggaacgaagctgccgtccataacatctatatgcacatactgtgctccggcctcgtcaagctgcttaagctgctctccaagtattgaataatccgctgataaaattgatggtgataagcagttcatgttttcctccgtttgattatgctttaaattaatacttttgtctgtttttcagctcctcatataaaagcttataattatcataccgcacctgcgatattttcccatctgcaagagcttccttcacgccgcagtccggctcatttatatgactgcagccctgaaacctgcaatatggctcatactctacaaactccggataacatgtccacagatcttccttttcaaagcccggcacatccatcgagctaaagcccggtgtatccatgatatacgtgccatcctttatcgggataatctcagaatgtctggtcgtatgctttccgcgctctattttctcacttatatgtccggtctccatctgcacatcatcctgcagacagttaatgatagatgacttgccaactcccgagggacctgcaaccgtggtcgtccttccctctaaaatgtgctttatctcatctatgccctcacctgttttcgtgctggtaaaaagcactctatagccagccggctcgtatatgcttttaagctcctgctgctctttaggtgtgattaagtcctttttgttgaagcatatggtaaccgggacatgctggtactccatcatacacaaaaacctatcaagcaggttgaaattgggatccggctttgcggatgcaaaaataaccagggccatgtctatattggacacagccggcctgataagttcgtttttccgtggcagtatacgctcgacattgcctatgtgcttttcatcatcgaggactgctatgtcgacgatatcgccaaccagcggctttatcttttgttttctgaaggtgccttttgctttgcactcgtagagagtgccgcctgtggcagtttcttttgcttctttggtttcttctacgtagacgtagtagaagccggcaattcctttaataatttttcctgtcatggttttccttgtgtgcttttgtatttgcaggagtcacgctttcggcggggatgcatgccgcgctttgaggttgtgtgggtggcgggggcaggcatatattcctcttaaaaaatatgaagccagccccgggctctcctacggacaggcgatggcttgctctgccctgttctttccccggtaggtttatggcaccccggggcaattcatatttttttctcggaacacatgcctgccccgcttccttagttcctctccgcgagttcaggttttcgtccgcgggttgatgcggtagtggggtgcggatagcacccactttgtgggtgctatccggtggcttactatgaagcgtgtattgggttgctgctttgtgcactatacgtgtattgtgtgtatttacaaatatgatggcgatatggaaaacttgacgtagctgcgctacggctcgttttcctcgtgctgccccaagctatggcaatatctacctcttttttgctattctggtttataataattatttaacttctcttatgcttatggcacgctatacgttactggatcaagtgtgacagttgcaggatttcctgcttcatctgtttcccctgtctgaactgtccaagtaaccacaatacttcctgtagcttctttcattgttccggaaactgtaaatgatgacgtattttcatatgaacccttatcgtatacagttccacttttacctacaagcttatactctgcttttactacagttccctctccactataactaattcctttacttacgttagtcgatatctcctgctttcccttactgagtgtaagtgtgattgtggtgcctgcggctacggtttcgccggatttggtctggctgattacgctgccggctggtactgtgtcgctgtactgggagtcagcataggtatacttgagccctgctcctgcgagggcgctttctgcatgtgactgtgaggcacctactacgtttggcacggtgattggcttctggcccggtgagagggtgactgttactgtgctgccctttgcggcctgtttctttgctgatggtgactgtgctgttactacatctgctgctacactgtcattgtaatctccatactcgaaggtgacactaaagcctgctgattcgagtgtactctttgctgagctcttggtctttccgattacacttggtatcttgaccatctctgatgtactatcaccttttcctgcgataactacattaatctgtgaaccacgctttactgtatctccggccttgacatcctgctcaaggattgtgccatccttttcatctgactgctttgtctcaaatgcaaatactgtgaggtcaagctttaagcggtctactgccttctgagcatcctccactgacatgcctctgatgtcaatcatctggccctctgtctcagtctgtgtctctgactctgattcagactcggtctgtgtctgtgactctgtctgctgtgactctgagttctttttgccgccaaacttaaacactcctgccactgaaagtgcaagatatatgataactattacaatgattacggctgttactatacccatgattgtgattgctttatccatctttggatttaaaagcttgccgtcatcatcatcgtcttcgtcttcttcgtcatcatcgtcgtctaagagtgactcatcatattcatcatcatcgtcttcatcgtcagcatactcatcaccattatctgcatcggtatcatcatcgtttaagtcctctgcaacacctctgccttcttttatcttgtcaagctcctccgggcttataaccttggtcttgccaccgtcaacgagtggtgctattgtaacgaaatcctcatcaggatgcgcaagagagcgccttatgtctgtgagaagctcctcaatagtctggtatctgcggtccggtgtcttttgtgtacactttaagatgattttctcaaagctgattggcagatccggtgcgtagatgcttggccttgcaatctcctcctgtaggtgctgcagtgcaactgccactgtggtatcaccgtcaaacggcacacggcctgtaaccatctcaaacattacgattcccagtgagtaaatatcacttctgccatcgacgaagccgtttcttgcctgctccggagatgcatagtgtactgagcccatcacatctgagcttattgtatttgaagatgtagcctttgcaattccaaagtctgtcacctttaccttgccatctgtagaaataatgatattctgcggcttgatatcacggtgaatgatatttttattgtgagcggcctctatgccccttgccacctggattgcaatacttgcagactccttgaatgacagctggccctttttctcgatataagtcttaagtgtgataccctcgacatactccatgacaatgtagtacagaccattctcgctgcctacatcatagatatttacgatatttggatgctcaagtcctgctgctgactgtgcctcagcacggaacttggtcacaaatgaactatcctccgaaaactcctgctttaaaacctttatagctacaaaacggctcagtatatggtcttttgccttgtatacatcagacatgccgcctgcgccaaccttgcttaggatctcatatcgatccgataaaaaacttcctatctctaacatctgttattacctcgtcttaaaatggtttaataatcattacagtgatattatcgcggccaccgtttgcattggccatggcgacaagctgtgacgctgctgtctcgatattatcattttgcctaatagtatcgcatatttctttatctctcaccatattggtaagtccgtctgtacacagaagaatcctgtcgtcctcacatagctcgacctcaaaaaaatctgcctccacatgatctgctgccccgacagctctcgtgatgatattcttgtccggatgaactctcgcctcgtcggcatttatctcacccatcctgaccatctcatcaaccagtgaatgatccctggtaatttgtctgatctgctctgtgccacctacaatataaagcctgctgtcacctatattggccacaaaaagcttgtttcctataatagttcctacgactaaggtggtacccattccacgcttagcttcatcctcacgagactcagccaccaaaagctcatttgccttgttgatagcctctttgatgatggataccggttcatccccggcatttctcgataccgatgcaaccacacgctctatagtgtatctggaagcatagtcaccggctttgtgtcctcccattccatctgctacgatgaaaagattcggaagatttcctactgcagtgtcagacgagaaataaaaatcctgattcatctcacgaatagcacctgcatccgtaatggaaaacgtcttcatctagtttattcctctctctttatctatatgcttcttgcgaagctgtccacaggcaccgtctatatctctgcccatttcccttctaatagtaacattaattccgtttttttcaagcctatttttaaaagcctctataacacccttgttggactgcacgtaatcgcgctcctttatcggatttaccggaatcagatttatatggcagttcatgccatgtacgagtgccgaaagctctgctgcatcctcggctgtatcgttcactccgcctaccaggctatactcaaaggtgactctgcggccggtctgtgcaaaataatatttgcatgcatcgaccacatcatgtatatcataactgtttgcaaccggcatgagagcttttctcttttcctggttggaggcatgcagtgaaagcgccagcgtgatagaaagcttttcatctgcaagctgtctcatgcgcggtactagaccacatgtggaaactgtcagattgcgctggctgatattgataccgttttcatcagtaagaagctctataaagcgcagcagattgtcgtaattgtcaagcggctcacctgtccccatgacaactacatttgagatgcgctctcctatgtccttgcctatctgataaatctggtcaatcatctcagacggcctaagccccctaacgagaccatcaagagtagatgcacagaatctgcaccccatcctgcagccaacctgcgaagatatgcatacagagtttccatgcttgtacttcataagtacactttctatgacgttgccatcatcgagtgcaaagagatattttctcgtgccgtcgagctttgacacctgcacctcctctttttttagcgagatgagtattgcattgtcctttaatacctgtatgaacttttttgaaatattggtcatctcatcaaagctgtccacatgcttcacatgaatccactcatatatctgcttcgcacggaatttcttctctccgagcgatatgataaactctgtgagctcgtccatattcattgatttgatgtcagttagttgttcttttatctgttccatatcatttttattaagtctgcatttaactattgttttataaatgttttttcttatttgttttgcttattgtttattacttcactaattatatcctgaaatctggtttcgtaattaaaattcatcatttaaatctgcataaacaaattcttctaattcgaaccaatttatatttattaattcatgatttattttaatatcataatttgctttttatgaatcttgcaataaagaatccgtcacttccatgctcaccgggcagtatctgtttcattccggtgccttcagcaaagctcttatccagctcaaactccggatgcttttcaataaaccacctcacattgtcctcattctcagcctcatctatcgtacatgtactgtacacgagcactccgtttggcttcacgtatgtatgcacggtatcaagtatctgtctttgaagagcggcaagctcatctacagactcaggcgtcatcttgtagcggatatccttctttctgccgagcactccaagccctgagcacggcagatcacaaatgagtatatctgcctttcccgccgaatcagcatcaaatactgtggcatcccacacctctgccgacatattgttaaggccatgcctttctatattttcctcaatcatatcgaccttgttatcggtcaggtcacgtgcgagcacatggccgcttccctgcaaaagctcagctatatgggtgctcttgccacccggtgctgcgcatacatctatcacatagtcgcccttctttggagcagccgtctgtgcaacaagcatggagctgatatcctgcacatagaaaagtccgtctctgaagctctgcaagccattcaaataatcaaatccagatataacaaatgcatagttaagttcatcaaccgctgtgaccgtcacaccctccgcctcaagcatcgcgcgaagctcatccggagtacacctggtcaggtttgtcctgatgcttattgtgctcttactgtgaaaggccttgaaaatctcctctgccttcttctctccgtatgctgatacaaatctgtccactatccactgtggcatggagtatcggatgcttaaagtatcaaactgtactgaatctatatttcttgcaatatttctgagtacaccgtttacaaagcccgaaagctgtgcaaacttatgcctctttgcaagcttcaccgcctcattgcatacagctgaatccggcaccgcgtccatgtactttatctggtaaacgctcatgcgaagaaggtttctgatgaagggcttcatcttccttacctttgtctttgaaaaagagtctatgatgtagtcaagctgcagcatatactcgatagtaccgtcaacaagcctcgtcataaaggctctgtcatgctttgacagatactgatacttgtcaagcacactgcgaagcacgatatgtgaaaatgctccacgctcattaatctcaataagcatctcaagggcaagctcacgcgtatctacagagtgctcattatgcgctgccacgtttgattttgcaggtctgcccggtatattatttttgtttatttggctatttttattattatgattatttttactatgattatttatcatgatgatgtttccgaatagttacatatacatttaattttctaactaatatatccaatttgaactgccaccctgtaaaatcacaggcaaacagaatctaaaacaatatcagtcgtcccgtctgcgtccgtttgtgataagtatgatacgaaggagctgtaaaatagcagccgccgcactggctacataggtaagtgccgctgacttgagcacccttcttgtgtacctaagctcgtcatctgcaagtatgccctgtgtacgaagcatgacaagcgcacgtcttgaagcatcaaactctaccggcaatgtcacgagctggaaaagcactgctgccgaaaacagcaatatgcctatatcaataataagccctgacgagcgtgtgttaaataataagccgataagtataaccggccatgcaagcatggagccaaaattggctataggtacgagcgcactcctgattgaaagaggtgcatagctttttgcatgctgtatagcgtgtccacactcgtgggctgctacgccaagtgctgcgaccgatgtggcattgtacacaggatcagataaattcactgttttggtgcgcggatcatagtggtccgtcagactgccggacacatgacgcacctgcacatcatatatgcctgccgcctgaagcactctttgagccacctgtgcgccattcatgcctgacatgcttcttagctgcgagtatttattaaatgtacctttaactcttgccgatgcaatcatacatatcactgcacctatcacaacgagtatatatgtcggatcccaataataatatcccatgtatcatctctgctactaaaaacatatacaaatgtgtatatgctagatgattcgctacaatctcacgatttgtagttactgcttcaatgtgtatgctttggcgattataaacaatacgctactcacaagttcttgtacactccacagtcgtaaattcccgactaagccatcggtacatacctataaattctttaaattgattagatataggttttcatctaaatagcttttcctttcttaatattttatgtttcgctacttggttttcgtaggcttctaccattgtctaaacgctaccatcaaggttctatcctataattagcaagactgtttcaacttgcactggctacttctcaacgtttccgactgctttgacgttagcacaaacgaatactctggattttgagtatctttgagaacattgactcacatttaattatgtttttagttacttataatgaataactataacgtgaaaaatgagccctcttccacatgacagcctctcaaaaatgaacctgtatccatgcgcttcttgccctggagctgtacctctactaaagataatgctccttttcctgtctgtacatacatatcattttttccgatatgataaatacagcccggctcataatcatcgctgccgtcaatcacctttgcactccacaccttaaatgtcttaccattcaggtgggtgtatgcgctcggccatggattaagcccccttataagcctctcaatctcaacagccggctttgtccagtcgataaagccaagctccttactgatcattgatgtatgtgtagcctcctcgctgttttgaggagtatactctgcagtgccatcctctatcatcttcatggtctccacacacagccttgctccctctgctgagagcttatcaaacaggctgccgccggtctcatcaggtgcaagtctgactgtactctttgcaatcatatcgccggtatcgacaccctcatccatcctcatggtagtgacacctgtaaactcgtcaccgttaatcacagcccactggataggagccgcacctctgtactttggcaaaagtgaagcatgcacattgatacagccgtatcgaggcatatcaagaatactctttgacagaatctgtccaaaagcaaccacaattattatatctgcattaaactttctgagatactctatattagcagtctctcttattttaaccggctggaatacctcaataccgtgcgaaagcgcacactccttgaccggtgtatactgcattgtcttgccgcggccctttggcttgtcgggctgtgtgacaaccagtgccacctcgtgccctgcctctataattgcctcaagtgttcccaccgaaaagtccggtgttcccatgaaaattactctcatcttactgcctcccagatattttccaagctcagataacaaatgtcatcctaatgattactcctgtgtatcctcatatgtcacatcgtgaagtgcgccctcaaccttctccacatagagatgtccgtcgagatggtcaagctcgtggcagatacatctggccaaaagctcttctccctctatctcatactcattcatatcctcgcccatgaagcgagcctttacataattcgggcgggtcacctgtccggcttttcccggtactgaaagacagccctcatcgccggtctgctctccgtcagactcgataatttcaggattaatcatcacgattggaccctcgcccacatcgataacaacgatcctctttaatatgccaacctgtggtgcggcaagtcctacaccattagcctcatacatagtctcaagcatatcatcaataagtgttactatctttggagtcacctccgtaacctctctgcagaccttgccaagtacagggtctccctccactctaatagttctaagtgccataattgcctccttctatatctatcaaaatccactcatcggattgaaatcaaatgagatattagcatgtttcattgccgtatcagctttcacagcctgctctatgacatcctttatggaaatgagcgccgcatagtcagatgtcttcatgtaaatcaccttgcggtatatgtcatttaccttggcgatgttcgcatccgcaggaccgatgagctgaatcagatgcctgtcatcagggctttgattttcatctgtatgcgatatcatctgcgacgctatatcgtacacttgctgtgccatgctactgcactcactctcatcaggcgatgtgacatgtactaaaagcatattccatacaggtggatagttcataagccttctgtactctatctccttatcgtaaaaagcctcataatcctgctctttggcagtccggatggcatagtggtcagggtcgtaggtctggataaccacattgccgggcagctttcctctgccggcgcgccctgccgcctgggtcagcagagcaaaggtgcgctccgccgcatgaaaatcattcacatgcagtgacatatccgccgccagcacaccaaccagcgtgacatttgaaaaatcatgtccctttacaatcatctgcgtaccgataagtatatcggcctcatgattggaaaatgcctgcagaatcttctcatacgcatccttcgccctcgtggtgtcataatccatgcgcagtatacgtgcctgtggaaaacgctttgccaccatcgcttctatcttctgtgtgccggccttaaagccgctaatgtacttcgagccacagctcggacacaccttaggcaccggctgtctgtagccgcagtagtgacagaccatcactccgccgctatgttcactgagtgatacatcgcaatgaggacattttaccacaaaaccgcacgctctgcacgacataaatgccgatttgccccttctatttaaaaaaagcatggtctgctggccatttagaagccgctcctccataagctcctgaagcctggtggaaagaatcgagcggtttccctcacgaagctcctgcctcaaatcgacaacctcacactttggaagaggtctgtcgtccacacgcttatccagctccaaaagcctgtaaacgcctgtctttgccttgtaatagctatccaccgacggtgttgcagagccaagtaccacaatagcatcggacatgcgcgcgtactctatcgccacctccctggcatgatagcgtggcaccgactcgctcttgtatgaattctcgtgttcttcatctattatgataagtcctaaatttgaaaaaggtgtgaacagcgccgaccgcgggccaatcatgatgtcaatatcaccattcttagctctctcaaactggtcataacgctcaccatttgaaagtcttgaattgattatcgaaaccctgttcccaaatctggcaaaaaaacgcatcacggtctggtaagtaagggcaatctcgggaatcagcacaatcgcctgacgcccggactgtatacagtgtgcgataagctccatgtacacctctgtcttgccgcttccggtgacacccttaatcagataagtatttctaagaccggcggcaatgtcgccttctatcgcatcaaccacactctgctgcgcggcattcagtaccttatcataggtgtccacactcatatgctccacaggatttctgtaaccgctctgtgtgatgacctcgataaagccgctctgctcaagcgctcttatagtggcagccgacaccgacagcttgcctgtcacaaaggaatactcaaggcgcgccccatcatcagcatcaatcagcgcacgaaaaagcctggcctttgccttttgtttttttgcctcgcaaagcgcaagctgcgcccttgcctttaccttgtctattttcagtgcaatactgcggctcacctgctccttagcctgcttctttacaggtataacagtcttaagcgcctgattcatggtagagccgtaattgcgccgtatccatgccgcaagtgcgatgagctttgcctccacagccacagagtctgcctttatcccgataagaggctttgtccttgccgggtcgtactcaggcttatccgtgacctcaatcacatagcctgtgatagtgcggctgccaaatggaatatccacgcacacacccggacggatgtcgcataaaagctcatccgggatgctgtactgaaatgtcttatccagtttttcgtgggatatatccacaatcacgttggcatacataactgatactatttaactccttcgtatttctcctcgcagtacttgcagcggtagatttcgtttttctcatcggaaagcacgaaaatctggtcaagctcctgctcaattgaagtgatgcatcttgggtttttgcacttgatgacatttttcacctgatgaggcagcttaagctccatcttgtccacaatcttatcaccctttatcacatttacagtgatattgtggtcaataaatccaaggatatcgaggtctaatgactctatcggacactctaccttgatgatatccttcttgcccatcttgctgctctttgcattctttatgattgcaactgtgcagtcgagcttgtcaagctttaaatccctgtaaatctgaagactcatacctgccttgatatgatcgagcacaaagccctcatgtattccactaatattcagcatattatcctcctttagtcctcagccagtccaagcaatgtcagaataagcgccatacgcacgtaaaccgcatactgtgcctgcctgaaatagcatgctctcgggtcatcatccacatcaacagaaatctcattcacacgtgggagcggatgaagtacaatcatatcatcctttgcaagctccatcttctcctttgtcagaatgtagaaatccttcagacgcacatagtcctcctcattgaagaaacgctccttctggacacgtgtcatgtagagcacatcaagctctcccatggcatcctcgagcttttctacctccttgaactcgatattgttggcacgaagcacatcatcgcgcacatagtcaggcaccttaagctcctctggcgagataagcacaatcttcacattgtcatatctgataagtgcattgatcagtgaatgcactgtacgtccaaactttaaatctccgcaaaagccgattgtgatattattcaatctgcccttgatggaacggattgtaaggagatcagcaagtgtctgggtaggatgctgatgacctccatcgcctgcattaattacagggatacgcgatttctctgaagccacaagcggtgcaccctccttaggatgacgcatggcacagatatccgcatagcaggaaataaccctgatagtatctgaaacgctctcgccctttgacgcagatgacgaatcagcactgtgaaaacctaacaccgagcctcccaaattaagcatggcagcctcaaagctaagcctggttctcgtgcttggctcataaaaacaggttgcaagcttctttccatcgcacttgtgtgcatatttctcaggatgagcctctatatcatttgcaagatccagaagcttgtccaactcttctacagaaaaatccaacggactcattaagtgacgcataatttgcctccattctttttcgcgtaacaatttttattacattttttctatcatataataacttggcgcaatattcaagttggcttttacacttttttgttgtagaatatatgacagaatataactgttctgaacgcttagcaattgtattgaagttttcatacaattgcgacaatttcaacatcaaaaaggagaataatatgtctgtaaatgaatcacaaatcaaaaacaccacagccggcgcaatcgatgatgacgatgccgtaatctttaaggaaagaaagagactgctgtttctcggtctgccgtggactttcacaaaatataccgtcacaccgtcctttatcactgtagagtccggactcttgagcaccacagaggatgactgctacatgtataaggtagctgatgtaaagctcaccacatcactgatggagcgcatttttaagctcggcaccatagtctgctacacaggcgacgtcacaaaccctgagcttaagctcgttcacgtaaagcactcacgcgagataaagagctatctgctcaagcagtctgaggccgcaagacttaaaagacgcaccttaaacactgtggatatcggtgcgcacggagcagacatggcagatttggatcatgatggtattccggattcgctggaataatacagccgttgctgcgcagctgattttgctcatatatgtgtggatctgaatagttacttatgtccataaataaaaggggatgtgaaaaaaatcaatcgagttttttcacatccccttttatttttcaggtaactattcagaataattcacagattaatatagccgtccatcgttcttcaaataaccagcccaataatttgcatgaatttccatctgtaacatcagaaaagcttgacatctagcagcagaacatctgccagcaaaggaatgtggctagcaggctgcagcactcgctgcccctgccactagggcgtccgtatatgtctcccatatccgaataccacgagccaccattttcaattatctgcataaactggcggtactgcatgttgtttggctcaagcgacactgctcgctgtatgtgttctatggctgtcgctgtgttgccgagcttttggtttgcgatagcactgtagtagtaccaccttccgcgtctctcagcaaaaggtacctcctcaagcaccttcagtgcctcattgtagtagccgttgctgatgaaattgcctgctgcacgcacctttggattgtcatcctgtgcactgctgcctgcattattgtaggtatagcggccatagaaaccaccaaacgatccacctgctccaaatggatcacctgctcccggtccactaccatatgctccaccataggagctgccgccgtatgagctgctgcttcccgcaccgccatatccaccggttccggcagcaccggactgcttttccttcattatctggtcatatgcctgctgcacctgcttaaacttctcctcagcctgatccttgttaggattgttgatattggcatcaggatgatattttctgcttaagctcctgtaggccttttttatttcatcgtcacttgcactgcggctgacaccgagcacctgatatggatctatcatttatgtttcttccttttcttcatctgaatatactcatacttgctccacacaccggagtatagaacatttctgattatatccgcatgtaagagaattggcaacctctcaaatatttttgctgcctctgaaagcatagatgtcatcataagccgacaggatttgtcaaatttttcctgatcattattgcagcaatgcatgagctgtataagtggattatatgacttttttttcacatcatccccaatatcctcatacgcatccattatataaataaatttgcccatatagcagccaaattccttcaaatccttctgccactcatcctgcttccacgcaaaaagtatgccgagcatctctcctgtcagccctgcaactgcatcaatattggtatcattgctcttctcgcactctgcaagccttgcaatatagtcctctatcgccttagcctgtatcggatagcctttttttgccttctcaaagtcctttttcagcatctctgcgtatgtcttcttcgtcaggctcttgtcatccttccagtcatctatcagattgtagtatgcaagcaggatgttcatggctgcagcatactctgtaatctcattggtgcgaagtgtacgcttcttcgtagggtgcacgctgcatacaaatccatcccgcgttacactatccggctcgtacaagcctgtcagaagcactatgagaaaagtcatgtcatagtttagtgccatctgtgcacgcctgccatactgcgacttcattgtctggcacagcccgcaataatagctttgatatatttttttattttcctcggacaaggtgtccttattgacagttatatatccaaacatttctcttctccatgctcttatgtacaggtatatatattgacgtaccagtacatcgaaaaataagtttctggctatatgacgcagaatgaattttcatctgcaaggcggaggaatgaggcgtagcggtggctacgtcgattgactacaacgccgcagatgggaaatcaggcaagtcatatggctggttacttattattcgatgtactagctgcgtctcacgaactgctcccggcacttcggacaggtaatacagatcttgccatgtcctcttggcaccctgacctcctgcttacacataggacacttgaagaacttgtactgcttcctctgtgcaaagcgctttttcctgcgctctgcctttacggtccactcatacctggcatttaaaaacttctgattctctgcatagcgcttgtttacatttctcgaaaatacacgaaaatacatatgtatcatcagtcctatagccagtatatcaagtatcgccgaccttgtaaatattgaaaccacaagtaatatcattactacccatgactcagcccttgcaagctcgtccatcccgtttcttccattcataaatctgataaatttttctctcatattaccgcctcgccctatattttcattatagccaaattcttacctcatacagtgtccacgctatgaatttgaggttttaaatcgttctttacatttattaagataatattgaagataaaaaccgtcaatagacctatcgtcttttaagaaacattttatatttcgtttattaaagttggtaaaagggcttgatttttggaaaaatgcttggtatattaaataaatatgcaggacaggtgatcgcggctgcaggtgtcgaaagaccgcaggtgaggaaagtccgggcttcatagggcaggatgccggttaacggccggtggaggaaactctaaggacagtgcaacagaaatataccgccacttttgtggtaagggtggaatggcagtgtaagagactaccgcctcactggtaacagggagggcacatgtaaaccccatccgaagcaagaccgaaacaaagctttgacgtggcccgccagctttaggtaggttgcttgaggcgtctggcaacaggcgtcctagatagatgatcactcaacgacataacccggcttatcgtcctgcgtattttaataatctaaagcctattggcgtttcgtaaaataactttttagtaacgtgcgccgcaaggtgcaccattaaaaatgcaactgagatatctcagttgcattttgttatttcccggtaactatcatttgctgttgtatatgatgcagtctaccggtaattattatttgctgttgtatgtaataaagtctaccgtcatctctatctgctcctcgaaagccacatcaggtgtaccgtcccctttttgcagaccatagcttccaaaataagaatggcacccgccatcaatgacatactcatatgtatcctccggcaggtttgagcggtatttgcggtatttgtccatatcaagcacaccatcctctgaaccgtacacgctaaaaaccctcagatctgaatccgacaggtcaacggtagaatatgctgcaaaaagatatagtccgtcaaactcatcaacatgctttgacacatattctgcagccatggctccgcctaaggagtggcctcccatgtaccattcctgtatggatgggtatatttccttgtatttttcaatgataccgtcagctgcattcttgtccagtactgcgaggttgcccggcatatgtacaagtatgcacacgaaattattctttgcaagctcatgcatcagcggcgcatacgcagtatactgcaccctgcctcccggataaaaaatcaatgcctttgtggctttttccttatcctgcggtgcaaaggttatcgtataattcttatttcttaagtcgtactgggtggcctgtatacgcttgtccttcttttctatggtaacagaaacctctctgtctgaatcgattgcagcctccgcaattgaatctgcacgataataatttcccacataacaatttacggcaataccgcaaatagccatgactgcaattgccacaagcagtattctatacacagccggaatgcgggattttttagttttaaacattaaagcagcttcctcctacaaactcacgaagcagtgaattgtttggtatgccgtcagccggcatcggaagaaagtagtctaagagcttaagcagcctctttgcctcgagatactccgggcagtctctttctatgccaaaaagcaacggctccgcatacaccttgagtaccgcaagctcatacacaagtgcagagttgaacatcacatccgcctgttcctggaaaggaaagatattctccctttcaccctttctgacagacggccacatagcgatggtctccatggcattggtacctcgtgtacgcgcatcacgcacaatccgtcgtataagtctttcatctgtggtggaaagaggattgtgctcgtcaatattgagctgtgtaagcgctgagatataaattttgaacttgtgctcaggcgggataagctgtgaaagcctgtcatttaagccgtgaataccctcaataacaagtatatcatcagggccaagcaccagctttcttccgcggtactctctctttcctgtcttgaaattgaaggatggcatatcaacagcctctcctttaagaagcctgttcatatcctcattgaacagctttacatcaatagattcaaggcactcaaaatcaaagcttccgtccggatgcttcgggcaaagctccctgtccacatagtagtcatccagacttaacggatgtggctttctgccctttgcgataagctggattgacagtctgttggcaaacgatgtcttgcctgatgatgaaggacctgctatcatgacaaatttctttttgtcatccgaagcaatctgcgctgcaaggtttcctatcttctgctccatcagtgcctcctgaagcagcatgatttcctgtcccctgcctgcagcaatcgcatcatttagtgagcctatcgtgccaattccaagcatcttgctccattccctggaatcatccagcgtgtgaaacagcttatttgatgtcacaagcggctcaacgctcctgctgtgagcacccggaaaaagaagcacaaagccactctcatacggcactatatcaaagtatttgagcatgcctgtcgagggtgccataaatccgtagaaataatccaccacaccatccaactcatagagattgactctggagcttctcctgtagtgcaatagcctctccttatcatgcagccctttttccttgaaaagctgctccgcatactgtgttttttcactgtgcttggtaattgggaggtctttttccacaaatgagtacatgctgcagactatcctgtcgatatcatgctctgtcacgcttttctcactgttttctctgctgccttggtctgtatcttcattatatttttcctgttggctgtccgcacactccaccgctttctcaagctgacaataatagccttctccgagcgaatgcatcacatgaagctgtgtcatgctgccatatacatcgtatatagccctctgcaaaagcagcacaacacttcttctgtatgtacgcctgccatccctgtcagctgtcgtcacaaagctaagctcacagtcactttttattttcttattcagttcacgaagcctgccgtttacaattccaaggattatgtcatcctcataataatccttgaatctgtccgctacggcttctaaagtatcactttctgatgctgtcactgccatgacctgtccatccggcaatgtcaccttcacactatattcctgcatttcttattgcccccatagtcgaatatgctgcctcattgtatgccatcatctcgtttatctgctcgattctgtccatgatggaatcactcatctcctgtgtccttagctgctgcatgatggcagccagcttgtggtgttccctgacaaggaacttacgaagcaccggattaccgtttttgataagtaccggtccgtacaaatcgcatacagtaaccgtcgtctcgtccatattgtcccatgcggaattgtccgcacacggcacacatctgaacatcggatagtattttccgtcctccaaaatcatatcctcatcaactatcttatagcctgtgttccttacatattcacggactttgctcacttccgactgtggctgcagaatcagctcctttgccgacctgcacactgtctcccctgcggttaaaatgtgaataacaagctctcctcccattcctgctatgacaatagagtcaacctctccgtcgtgtatcgcttcaagcccattggaaagccttgtggtaatctgctctgtcagaccgtttgcccgtatatgctcattggcgcgctcaagcggtcccttatttatatcaacagcaattgctttcggtattatattactctgcaccagggcaataggcacatagccatggtcggttcccacatcacacagcgtgtagccggccgtgaccattgatgccactgccttcattcttctggatagcctaatcatcttactctaagtagtccttaagctttctacttctgctaggatgacgaagctttcttagtgcctttgcctcaatctggcggatacgctcacgagtgacgttgaactccttacctacctcttcaagggttctggctctgccgtcctctaagccaaagcggagtgtgagtaccttctgctctctctctgtaagagttccaagcacctcctcaagctgctccttaagaagtgtgaatgctgccgcatctgcaggaaccggtacattatcatccttgatgaaatcaccaagatgcgaatcctcttcctcaccgattggagtctcaagcgaaacaggctcctgtgatatcttgagtatctcacgcacacgctctaccggcatgctcatctccttggcaatttcctccggtgaaggctctctgccaagctcctgaaggagctgtcttgacacacgaatgagcttgttgattgtctcaaccatatgcacaggaatacggattgttctggcctgatcggctatggctcttgtgatagcctggcgaatccaccatgtggcatatgtagagaatttgtagcccttcttgtaatcgaacttctcaactgccttgatgaggcccaggtttccctcctgaatcaggtcaaggaaaagcattcctcttcccacatatctctttgcgatgctgacaacaagacgcaggtttgcctctgcaagacgctttttggcatctgctcccttgtccacatccctctgcagtgtctttatctcttcctttatctcagccttttcctcttccgatgcaccatcaaggcggccctttagtacattaatcttctcggttgctaccgctccgtcctccatattctgggcgagctcaatctcctcatctgctgagagaaggggtaccttacctatttccttaagatacatacggacaggatcctcgacgctgaccccctccggtactgagagatcaatcttttcaacctctacctcgtcctcatcatcgagtatgatatcatcatccacgtcatcatcattgctgattttaagcacgtctatgccgttttgctcgagataatcaattaccatctcaaacttctccggatccagatttaagtccttgaaaaaatctgcaatttcctgatattcgagcatattctttttcttttttccaagctcaagaatctcaataagcttctgctggaaattcagtctctgctcctgctcctgtgccatgtctttttgttcctttttctttgccattttattttcctctttattctggtattttttgcaattcttcgagtgcacgcttatcctcaataatcctcatcatgccctccatatctgtaggtgccagatgctttgagcggtagtctatgctgttttgcttgatacggacaacggtttccctgagtgcggttgccttgtcatttttcccctccacctgatggattgtggcattgaaaagccctgccacctcgcgctgttcgtcctcatcggtaaacatgcttactatcctggccggatttactgtatgcgtggtctcgtactgtgaaaaaacctccttagccaccttgtggtacagctcttcggtaaagtcatctgcactgatacgcccctttatcctgtcaaaaagtgaattatcctctatgagccatgtgaggagaagcttctgcgactgcttcatgccatcctcctttttatttttctcattgattccacttttaagctttgtctggggctttacgataccgcccttcattgccatactgtttacgagctttcttaagtcgtcgtatggtatgctgtactctcttgacactgcctgcgtatagtttgtccgctcaagctcctcggtaaaaccaagcagcttctttgcgatttcattataaaatgcggtttttgactcgggatcgtccatatcatagcctgcctgcatgatccgtatctgaaacataaagctgttttcagcctttttgatacgctcctcatactcctgtgcgccaagcgccttgataaactcatccgggtccttatacggccgcatgttaatgacctttgttgtgatgcctacctccttgagtatcggaatcgcacgcagcgctgcctttaccccggcgccatcactgtcatatgtcagatacacctcattggtgtatctctttaatagtgaggcatgtccgctcgtgagcgccgtaccaagcgacgccaccgcattgtcaaagcccgcctgatgcagtgctatgacatccatgtagccctcacacaaaaggagctgatttttcctcgtgctccttgctatattaagtccgtaaagattacggctcttatcaaatatctttgtctccggagagtttaaatactttggctctccgtcacccatcactcgacctccaaagcctatgacacggttgtgcacatccataatcggaaacatcgcacgattccagaacttatcgtgcccgcctctgacctcatctatcgtcacaagacctgtctccttaagtatctcatcatcatagcccttgctgcgcagatacttgtacagatcatcactgtactggtccgagtaaccaagcccgaacttctgcattgtctcatcggacagctctctctttttgaaatactcatgcgccctttgtcctctcggtccacgaagcagcatataaaaatactttgcagcctctttatttatctcaagcagctgtgtgcgcctgtctgcctccctcctttgtgctgatgtcatctcctgcttgggaagctcaattcccacacggtctgcaagctcctgcatggcctctgggaaggtgaagttctcatactgcatgagaaatgtaaatacattgcctccggctccacagccgaagcaatagtacatctgcttattcggtgagacggaaaaggatccggtcttttcgttatggaatgggcataatccaaaataagtacttccctttttctgaaggtgcacgtagcttcctatgacatcgactatgtcatttcgcgaacgtacctcctctataagctcgtcagagtagtacggcattttatcatccccttactgttcatctttgttgtcatttgtgtcgcccggcgagcgcgtctgcagtgcggcacttagctcttacaaccggctaacgctacgctgctaagagtctgtacgaattatcagtaaccatctatttcccaggctaccggtacgaaatactcgtggaacttcgtggtggcatactggtctgtcatgcctgatatatagtcgcatatgatacgccccttgtcatcaccctgctctagcatgacgagatacttctgcggcagctcctctatatgctccatataatagaaataaagctgcttgagcatcgccttggcctttttctcctcgctttttgcgactggattgttatagaggtttgcgaacatgaatttacgcaaatcctgcattgcctgcgcggactcttttgacatgcatatatcgtcctttcccatgctgtttgtgatgatattgtgcaccatatgattaagcctggccttggtgctgtgtccaagcgtgtttcttatctcaagcggtatatcatcctcgcacagaagctgtgcgcggattgcatcatcaaagtctgaatttatgtaggctatcttgtctgaaagcctgactattttgccctctaaggtgtgtggcatgagcgaggtctggtgatttagcataccatctctgacctcccatgtcagattgagtcctgctccgtccttttcgagcttctccactatgcgcacactctgctcattatgcttaaagccaccctcgtatatctcattgaggatgcgctcacccgcatgtccaaacggtgtatgccccaggtcgtgtcccagcgctatagcctccaccagatcctcattcagtctcagtgccttggctattgtcctggcattctgcgacacctcaagcgtatgcgacatacgtgtgcggtaatggtcgccctttggcgtaagaaacacctgtgtcttatttttcagacgcctgaatgccttgctatgcagtatccggtccctgtcccgctgaaaaacaggcctgatatcgcactgtggctcatcatagtccctgcctcttgagttgatgctcaggcatgcgaacggactaagtatttcctgctcacgtttttctatctgctcgcgaatagtcatttatctgcctcctcgctgtcacagtcgttatgttctgctgctattcacacaaatgtaacaaatagcgttacattccactaattattctctacattagttattattcgacgtgatttttaaaaatcctttttttatttctttttactttaattttctttcggcaaaaattaaatgctatatcaattaccgccgagcacatgtcgcagcatctgaagctgtccgcctgtgatttcattgtcgtagctgccatagtaaaatttatcgtcttttgccagtatgcagcccacccaggtgcccacatgactgtcactctctatggcatccttcatggatttgtagccctctattgtaaaataggcatcatagctcttgaagtctgccggatttattttcactgcaccaaaggtatcctcaagactttttatgaaatcctcatcgcactccgtatagcctgtgacatccttgctgtagcgcgactctgactgccactcctcatcccacatgagaaaaacgctgcagtccttccatgaattgcttttttcaactacagacagcttcttgtatgaatttgatgcgttgcccgccatctgtaaatatgtatcgtcaccgttcttattcatatataagaggtttgaagctgcaagctcatagtacctgctgccatagtcctgatccttgtatacaatatagccaagcggactgccggtccctgcatagtcaagctctatggttatcggaatatacacctgactgtcataaaccataggcccaagcctgtcatcatttgtgatacagcttgcaaccttttcatactcagccggctcgtttgaaggcgacatgaaatatgtgtaaacaacaataattgcaatgacaacgaccggcacaatgactattacagcttttaatgttttccttcgaaccctgcgtctgtgaatgcgcactttcctgtctgcatgctcatcgcaatacctgtattttaccagtctatatacaacaaaaagctccagcacaagcaaaagcacagcaaaggccatcatacagccggcctgccacatcaccttgtgattgacaaatttcttatctataaacctaagcggtatgagtattatcgtccaaaaaagcgtatctcccaacacataccgtgcatatattttcctgctttttattacggtaagcggaaaaagtgaaacaatcactgtcagcatgagcacaattgcaaaaaaatatccccatatctctgacagggttgagccgtacagtgccttgaaatactgcgccggaccaagctttttgatatttccccagcctgagaattttgagataaagagcactaccgtgccgataaaccatgtcagtatatagatgcccatgtagcatgccatatttttccttgcaaagctgccatatctcataatggaatatgacacaagcacccctgcaagcacgggaaatccgccaactctgccaatcaaaagatttacatactccataacagcaaaggacaaaacaaacacacatattacattaatataagatagattcaatctcttcacgctgcaatcccatctccaatataataatcaaattcctgtgacagctgtacccctcagtgtggcagtcaacggttacagaccattaatagccaataggctttcaaaattatctgcacaaaataaaataggaagccgttcaccgacttccctgttaatgcaggagatgggacttgaacccacacgatattgctaccacaggcacctgaagcctgcgcgtctgccaattccgccactcctgcgaacaagcattattctaccaaaaagtttagaataatgcaagcataaatttaaaaaactatacgaaatgtacgaaaaactataaatctgttactacaccagctttgatatatctaaaaccagtgcatcaacctcctcctgttttgtagcccagctggtgcagaatcgtactacagtgccatccttcgttctttccatctcttcaaaatagtatttctcggcaagtgtcttcttctgctcatccgataaaatcacaaactgctgatttgtaaagctctcaacccaaaacggtaccttcttctgttcaaatgcctctttaatctgcatggcaagctcatcagcacgctttgtcttttcaaaataatcgccattctcaagcatagtggcaaactgtaagcccatcagccagccctttgcaagcactgcaccgttttgcttcatataagccttaaaacgatacttgatatcctcagcatttataaccagcgcttcgccaaagagcgcaccacactttgtgccaccgatataaaaaacatccgaaagcatggcaaaatcacaaagtgtaaggtcatttttatctgagcccagtccataccccattctcgcaccatcaacaaacaggtacatgccgtatttcttgcagacagcactgatatcgcaaagctctcttttcgtgtaaagagtaccctgctcagtcggaaatgaaatataaaccatctttggctctgtcagatactcaggctttgcattgtcataatactctgcagcacacgcctcaatctgcgcagcactgattttaccatccgtgttaggaagcgcaagaatcttatgacctgtattctcaatagaagctgcctcgtggcaattgatatgtcccgtatccgctgcaatcacgctctgcaccggtgaaagcgccgccgcaaccacaacataattggcctgtgtcgcacccggaataaatttaatcatggaatcatctctgccaataagccccttaataatctgctcagccttatcgcaccactcatcctcaccatatcccggatagctggttgtatttgtatccgccagtgccttcaaaatgcaatcaaatgcaccgcggttataatcgttattaaatctaatcataaaaatatttcctttcctgtcttatcattatagagagcctgccccgcaacgaccggagcggagaccgagtgaggtccgggggacctcatgccacgagccgaccgagccggaggcgagaccttgaaccatgggcgcctgccccgcaacaaccgaagccttgcggaagatgggttgcaagacgtccgggggacgtctgttctgcaacgaccgaagcggagcggagaccttggacccatggggacaaggtccgcttccgcttctaaaattaaaaagggctaagccctaaggcttaaccctttttagttttataatgcggaagatgggacttgaacccacacgattgcaataatcacaagatccttagtcttgctcgtctgccagttccgacacttccgcatgtattttgttttcgtcgcttgtctcacgcgactcgtatataatatcagattgttttcaaaaatgcaagcacttttttcaaaaaaatcttatttttttacagactcttttcatagcacaaaaacggctgcccaaacaggctgcattcacccactgtatcaaatccaaacactgcatacgagcgcagagccttcacattgagcttgttgactaaaaaatgcacacttttgtatcctctccttgcgagctcttccatcccaaataccagcatttgtctcgcaattttctgattctgaaaatccggatgaaccgcaagtcttgaaagctcagccccgggtgccagcttatggctccagcaatcaagcctctccacctgtggatcatcatcaattgaaatcgctgcgataattctgtcctctttgcttccggcatcagcattaatctcctgcccatcaatcattacaaacaaagattctctaccaagatcaaactcaatctccttcattcccggataagaatcatcccatggacaaaactccctgcctagctgtatcttatacaattttaaaatttcttctttattttcttctgtagctgctactattcttctcattctgtttctcatttccaactaaatataatggacaaggggattcaagcttgcaagcttaaagtttgtactctaatgaacatgaaactaccttcttataaatgaaaaatcatatacatttctgaacttttgcgttactctctgattgtgtgtataacaattataatacgataaccatacccattgcttcgtttctttttctaatcgacaatcctccatttgacaaaatttcacaaccccatttggtagactgttagaatttaatacttctgtcaatgctcttgaaaatgtattttcacattctctaatttcttgaatatgttttgtttttttcatattttcttccgcaatttctactttttttaatccgaatggaatcccagattgttgataatccaacgtatatccaaggcgaatatagtaaatgataccatctcgtacaataaaagcacttgatttagtcaaattcgttttttcattgttttttatataccaaatagtaattgggacaattataatcactaaaaccatccaatacacccaatacacatccgaaaaacatccaaaaaagaataacaatccccatacaagaataattattccaaacatcaaattaggatgtttttcgtaaatcctatgactttttatatctcttttcatataaacaatttcatttatatcgttgttgatttccatatttcatttacctcaaacctaatacattaacttcaaattcttctctcagtattactgaaatttattgtttaaaacttctaacaataaagtaaaccagccattctaccactaatatgccataataaaagaattctactgcatgtaatgttataaaaaacagacagataatctactacccatttctatgctcatttagcaacaatatattccatttcttcgtttttagaaagaatatctaaaagcctgaacactggtcctgttggatgagttctaccgccttcccatgcttccactgttttaattgaaactcccatatatgaagcaaatacactttgagtcatccccgcctttgtcctaatatcacgtatttcttttccactatactctttgaccggcaaaatcatatatgtttttactctacccgctccatatcctttctcataagctatagcttcctcgagtccttcttttaaatcctcaaataatgaactcatagaaaaatcacctcctatttttagcagcttcctctctcaacgatttaactaatttctttaaaacgcttttttcttcctctgtaagattttcctgactctttttttggaatgctgtaatcagatatattacttcatactccgcaaaatcagtataacaaactcgtacgctaccacttttacctctattctgaagtggaaatctgaccttgcgaattccaccagttccttccattataggtcctgacacaggatctttaagtaacattatctgaagcgctcgtaattcatcctcacctaatccaatctctttccatctttttgaaaacaacggaacctcaataaaagttcttgtcatttgtaattttcccttctctttttaactatattacaccctatattatagggtgtcaacacaattcatctttatatatgccatccctccattacttccgattttctctactaacgccaataagtaatattacttaatctcaaaaaattcactacaagatacctaagtaaattccaattcaggaaatgctttcctcaactcatctaccacaaaatagatttcatcctcatcacatccatccttgttttccttatgacatttttctaaatcttatcttgccacatctccgatcagaatacaaccaccctcttttaataatgtttttaataattgaataaattgaattttctcatcatctgttaggtgatgtaaggaatacgttgcaataataaaatcatatgcattgtagcatttttgtaaatggagattgattcatctaaaattattttattgtcgactgtattttactgctttcacgactgtctcaatgcaattaattgttaatgccaaaatgatgattgagagaaataccttattatagtgtataaaaacatgtgaaataccttctgcatccgttccaagtaactgctcaataccatcaaaaaatccactattcataatcctatcatttaacagccaaatgcttgttaatactccatcaataatattggtaataatggtaacaagcatcactcttttggtatagctgccatcaataagtctcacactgtcccttgtaacacccaaaattccaaatgcaagaatgaaataccatgtttgtctgatatattctaaattaaaaagtggttcatacacacctaccccattttttacaaatgcaatgcataaaatctgtgggcatacaagaaatacaagagtgaagataaccgaaaaaacaattcctacaatcgcatctacttttgaaatcctattagacttttgtggaacaggaggcaaattatctattccatcatttaacccatccaccttaattccttttttataaaagaatgcaaataataatgtcacaaatgcaaatcctgtcaatataccgccaaaaatcccaccgatggttctatagatagctatataccagattgtatgcgatgttaatgctgccataatttgggcaagtaacattcctccactgatgcacactgtcacaattttcaatacatacacatataaactgtaatacggctgtccaatcaaacaatcctgtgtttcacctttatatttcgaagctaactcattcggggttcccagttccgttaaaacaactttgatatcacgctccgttggagcaacatcctcacatcgttcctccaacatatcttgtatgatcgtctctaattccgccgccacgtcttttttcatggcggatttcatatgttttgtaactgcataaatgtatctgtcgatcaaatcattttttaccatttattcttcctccattaaaacattgattgactgtgaaaattttttccagtgttctttaatttttttataaaccagcttcccatcttctgtgatgatataatattttcttggcttcgttgcctcagtttcccattcactttttagcagaccttgactctctagtcttctcagtagaggatataatgtattgccttctatcgaaataccttttccttctaattcctttaccaatgaatatccatacattggtttatttagttgtgctaacactaccatgatgagtgtgccccgtctgaattctaaaattaatcctgaaacaatttcatcacaattcatcaaatctcctcccttcagtatcctttatttaaatccactgtgtttattgcactgtattgtgtgttgcacactatgtgtttaacatagtatactgtgtatcacacatcatgtcaacaagtttatcctttgcattttaatttttgcatattataccctatattatagggtgtcaacacaattcatgtcctccttacatttaatacaataacgctgaaaaaatgtggtgtcagtgacgggaatagccaaggattttgatatgtgattagcgatagtgtagataaaacaaaaaggacagtgtcctctcaacactgtcctccctaatttacatgattgaattttcataatcttgtaattcgtgatatataccttctatgatgaccctacttccagccactctataaaccaataaatatctatgctttgcaaaacttatttatcatattgcttttctgccaactctgaaagttctacatcaaacttctcattttcttatttcaccagcatctcatatgtaaccccatacttctgcgcaatctcgcttgcataagatttcccttccggaggcgccacttcaatctgataggagcgctctgtccccttcatgtgcacaatcatggaaaacgctttcccatctgtgtactctgccttctgctgctcttcattcatttcctccacatcaaatgccagcttatgcatatgtgtattataaatagtcctcattcccttatgtaaaattgccctgacactgtccttggcaatgtagtatccctcttcaaacgaagtggtagaaaatgattcattcatcaagagcagactcctgctgtcagcctcctcatagattgccttaaaacgcttacactcttccccaagccttcctaaatccaatgtcttgtcttcatctgccgggaaatgggtgtaaatacctgtaacaggggaaaatgtaaatgctttccccggaatatatatgccaccctgcgccaacacaaacaactgcccaacagcctgtgtaattgtcgtctttccacctcggttggcacctgttaagatatacactctcctattccggtcgaaatccatatcattcggtacaatatccccggactcctctgtctcaaaaacagcaagctttaaattgtaaattccacgtgcctgcatcatatacggatcagattcattttctcccgctttatatacagaagctttagcaaaggtaaagccctgttcctgcaatttttgaatgtactccgcccatttgatatagtagagcagctccggaatcaagtctgtcatgtcggtaatggtaatagaaacatatttgttcagtacttctctgactcttttcaccatatgggaaatcatatggttgacgattcggtctgtataacgagtcacatcctttgcctgatctccctcgggaagcttcacaataccaccccggctttccgaccgcataacagctgtatccatcaccttctgcataggagtgctgatcaccgcgtctgcattcacatcaaatggctgaaatttgaaattctttttccatatggtatcctcattgatccgatcctttgacacaatatggtcataaaaattgcccaggattccggacttggtaaaatatttgctgtttacagatatcagaccgattccgtccgcttcaaagcggtcattcaagttaatacctaccgtaatgctcttaagctgtgaagtgtccattttcagttctgagatatcttttttcagttctgcaaatccgttgtccgcatagattttctccacataggcttttaaacccagaaagcctgcggaatgaacgtccgaagctgccagacatgtatgaagcgcatccacacacttgatataatcattaagctcgtccagacgatgcaaaagatcccagatgcaggcactctcatcatattcccggttaaagctaccgtactccctcagaaaactgatgcgctctagtatttccataaggtcatcacgcatttttttctgttgaaggatatcctcgaaaatatcgcagcggtactgtgtcaccgccggatctgcatacaaacgcgccatcacgttttggatgtagttctgctcccgctcctttgctgacagctttttgcagatttgatccatccccagatcatgcatagtcacatcactcaaggtcctgtattgtgcatttgtatccgggtataataaactgtattttttctgactcataagattgacctctctttctgatctaatatgcaatcttgaactgaatatgtataacctgcctgtcccataacaaccgaagccatgcggaagatgggttgcaagacgtccggtggacgtctgttctgcaacgaccgaagcggagcggagaccgagtgaggtccgggggacctcatgctacgagccgaccgagccggaggcgagaccttgaaccatgggcgcctgccccgcaacaaccgaagccatgcggaagatggggcgcaagacatccgggggatgtctgctctgcgccgaccgaagcggagcggagaccttggacccatggggacaaggtccgcttccgcttctaaaatcaaaaagggctaagccctaaggcttaaccctttttaattttataatgcggaagatgggacttgaacccacacgattgcaataatcacaagatccttagtcttgctcgtctgccagttccgacacttccgcatatatttgattttctgtcgcttgtctcacgcgactttgatataatatcaaatcaaaccaaatatgtcaacacttaatttctatttttacatatatttttcatttattatgcatttaagctagtccagccccgcctttatccggtcctgtatattgaccagacactgtaggagaacaggattgaactgtccgcactctccatccagaatcatctgcattgccttttcatgtgaaaacgctctcttgtacacacgattgcttgtcagggcatcatatacatcagctacagataccacctgtgccgagattggtatatccaaaatgaatagcatgggcttttttctatatcttcttcgtgcatgttacatcttcttcgtcagatatatttctcctcaaagctttctatgcacattggcttatcgaagaaatacccttgtatgtaatatattcccatcttcttaattatagcatattgcctgtcagtctcaactccctccacgcagacatgtactcctattgtgttggcaagctctgtaaccatcttgacaaatgcatcagaaaaatcatcctccccaagatgctcaatgaagcatttatctattttaatgatatcaagaggcatctccctgatatggttgagtgatgaatatcctgtaccaaaatcatccagtgcaaccttaacaccaagcgcctttatctcactgagtatccgcttcatgcgcaccatgtcattgattgccagactctctgtcacctcaagacacagatttcccggttctatgcccacctcgtcaattatgcctttgattttcttaactatgtcattctgcagcagctgcaccacagacagatttacgttgaccttgtagtcaggatgtcccatgtcattccagtacctgcagtgcttcgccgcctctcttaatacatgctccccgattgggtttataagcccaagatactcagcaagcggtataaagtcaaccggatttataaagcccatagttgctgaattccatctgacaagagcctctgcacctgcacagacatcctcccccttcacgtttataatcggctgaaaatacacggtgaactcatcgcactcattcatcgtggcttttctcatgtgcttttcaagatcaagacgctttgtgcttgtgccatcaataccctcgttgtagaactctatacggttttttccttctttcttagcattgaaaagagctatatcagctcttcttatgacatcctccacagttcttgcatctgtcgggaaaaatgccactccggcacttattgtacagtaatagtcctctcccttcaagaaccacggtctgacaaatatctgctgtatatcattaatgatactctccagcctgtcaacagagctgcctgtcactatgacgataaactcatcgccacccatcctgtagcagtggttctcaattcccttcacctgtgtcaggctatgcgatatagcttttaaaagcacatctccgtactgatggccaagcccgtcatttatatgcttgaaatcatccagatctatataaatcatcgcacctctggtgtcgtttttcactgaatcatctataaacttagccagatcctgctcacatctcatcctgttatatagccctgtcaggaaatcattattggcctggttctcaatgcgctgctgataacgcttcttctgtgtgatatcatacattgtaacaagctgcaccttgcggccatccacccacgctatgcctgtgcgatgaatatcaaaccacttgtcctcctccgtcacgtagacctctgtaaagctccggctctctgcagtatgggaaaaaatatatttttccagcttgttctgttcgataatatttgaaagcagctgcttacagtaattattcatgtaaagtatctctgacttagacatatcagccacgtatataccgcagccggagttttccagtatcgcttcgagcgaagcataggagcctgcaagcgagttggttgttatcttttttgtgagaatactttgaatgacgcgcttcgtatcatttaaaaacttcacatcatatttttcccagcttctgtcatccttctcatcaaaaaagcacacatacatctgagtcctgttatctatatttacaggctggaatatagctgccctcatagcctgcttctccatgaaaaggcggaatttctccggcatcacagagtctgatgatataatgtaaggctttccggtgaaaaaaggcacctcggtaattgatattgtatcaaacggctttctgccatagcttacaatcacatccaaatgcatgccgtccacgtttttgcggatgataaaagcaccggtaagctttatggtagtaactgcactctccagtgctttttgagccatatcagtaaagcttccatccatctcaagcagttttataacagaattgatagcctcaagcatatgaaactgtttcttgatttcctcatctgacttcctgataagcgaaagtgcctcattcgcagcatcctcatctctctttgtgatcaaaagctgtctggtcatagtttccaggaactcaattgttctgttaagacgcgcttcactggtaataattatgccatcaggaagcaggtttctctcatcattagacatctgctcatcaattaccgcagctataatccaatatatatcgtgggtattgtccactcttacaatcagaccatacagcctgatatagtccttatccaaaggttcatctatgagattctcaaccctgcagtccgacagtctcaaaataagtttttcgtatttctcctcaccaataaatgtaagcatactcttccatttatcgttacattgacacacctctgtcatgactccatccttttttgtcagacacgacaaatatattccgttgaccatacagaaataatcctgtattttttttaaaagcttggaatctgacatattttcctcctaaaaactcacacaaatcaatcctcatatctgataacaaacaaataaaagtcattcttatcgagaatacatgtctcctgaagcagacggtattcgacacgcagcctgatttgtttcttcacaaacccaatctcatttgaatacatgactatgattccgccggataccagatgctctgcggccttgtcgaaaaacctctcgtaaaaaagctccatctccgccttggtctgtcggttacgaaccggcatatccgtaatcagctcatcaaatttgtagtcatgtctgaaatcaaagaaatccctgtgtataaaattaattcttgttttggcaaactcagcattctctctgcccatagtgattgcatctccataggtatctgtagcatatatctcgcgtgccgggactaaatgtgcgcgctctataagcagtgtaccaactccgcagaacggatccatgatttgtgctgtttccttaagatacggctttgcaagtgaaacaataagtgccgcttgtgacggatgcatcgacgtaggaagcacattctttctgtatgcaaatctattatcctgtatagaacataatctcatgcagacaaaataattgtcattttttgtcggtattagcttaatcaccacgtcgtaatcatttggtgaattgatcatcctgcccgcaaaatgcatatcgatagctttcgcaagcctgctctggtacgccgcatctgccgtgctctcaatacgatagtaaaacggaccaccctctcggtgcatgcgtcttaatatatcatacatatctgactctgcaagaagtccggctgcttcctgtgcatcctttggcagaagcgatgctgcatgtatggtaaagtacatttttctgaatgtgcgcacctgcatgataagaggtatattgtcagtctttacaagcactccaagcggatgcagctttgtatccttaaccggtatctgacgtcgtaccacctctctgtgaaggcggtttgtcatcagaagcagctcagcctttactccctcgagcacaggtgtatggtgctttatcccattatatttaatcaggattttatttatctcgtttaattcttcctcaatatgcttcctattttcagctgtgaccgtcatatgctcaagctcttttgcacgttccataagctgtggcaagagctctttgcagtccagctgtgacagcgccgccagatatgagccctttacaaagcgcatctgttcagcctcatatgctttaaaaacctcatcagaaagctgtgacatatgaagatctcctatcagaagcgctgcgttctttctggtttttgcatcttctgctcccataaacgacacaagcagctcatcttctcctgcaagcagctttagagcctctgctaatgcattttcatctttaatctcctgtctgaggctgctcagattctgacgtacattctctttttttaacagatttccgataatttccttcattttttaaatcatcctttaatttattgtatattgtcagttttggcttgcctcttcctttggcacaccattttcttcgatgtatgtatccagatccttgtgaaactgctcccacgcatcctcatgctccacgaaatatagcggacacttcttgcctgtcacatcgtagtgccttattacatcatcagcactcagatcataccgccccataagccatgtggtgagctctatgagcgactggtatgtgctgtcgttaaactttcctgtctcatcctctatacagcactctatcgatattgtgtcactgtttctgttattagatgcatacgatatctcattgcaaggtatgcactgcactatctcaccctctaatcctataacaaagtgtgagcttgctttggtctttttggtctctgccaggccattgaaatagtctctgttttgtctggctgacgtacccggatttgctgtataatggacaactatgccgtttaccttctcaagtgccttctgtggtctggaatacggattgggtgtcagcagctgtacatcaagctttggctgtataggattgtaaagagtactggtcacctctgcctttacctcttcctgctttgcctttttgccccttaaagctcccactatgattatcgttgcaattataagtattatcacgcctataacaatgccattgctaataagctgctttcttctaacctgggcgcggtgtctctttctatattcttcgcgctttctctgtcttatcttttcatactcgtccatttaattatccccggttatctcttttgtttgcttttatatatctattccaagcttttataaacatttgcatacatataagagtatattagcacaaatcgtcttgttatgccacataaaataatacaaaagcaccagatattacgacgtaacataatacccggtgctttattataaatgtatattcttattattaatcacacttaatctcgtgaacccatccatctggtccatcaatatggcccatctgaatgcctgtaagtgtgtcacgaagcttctttgtgacaggtcccatctcatccataccgcttgggaagcagatttccttgccgtggtctacaatctttcctaccggtgagattactgctgctgttccgcaaagtccacactcagcaaaatcctttacctcatcaaagagcacctctctgtgctcaaccttgagtcctaagtacttctctgcaactaccatcagtgaacggcgtgtgattgatggcaagatgctgtctgatttaggtgtaacaaatgtgccatcctttgtgataaagatgaagtttgcaccacctgtctcctctacctttgtacgtgttgcaggatcgaggtacatattctctgcaaagccctgtgcatgtgcatctacaatggcatgaagactcattgcatagttgagtccggccttgatatgtcctgttccgtgaggtgctgctctatcaaagtctgacacacggattgtaattggctttgcgccacccttgaagtatggtcctacaggtgttacaaggattctgaactgatactcatcagccggcttaacaccgattactgcatttgttcccataatgtatggtctgatatagagtgtagcacctgagccgtatggtggaacccatgcagcatttgcctttactacttcctcaactgcctttacaaatctatcctccgggaatacaggcatctcaagtctctcacatgaatccttaagacgctgtgcgtttaagtcaggtctgaagcagacaattctgccatcctctgttgtgtatgccttaagtccctcgaagcatgtctgtgcatactggaatactcccgcacactcattaagtgtcactgtatgatcctttgtgagctgtccatcgtcccactttccatctttataattagaaacatagctgtaatctgtttcctggtagccaaaactaaggtttgaccaatcgatatccttcttttccatctttatatcctccgtttctttacggatccgatataacctagcgttatcatatatcgggtctactatcatttatgctcattctagtacaatagaaaaaaaatgtctagtactatttttttataataactataacttaagtttctatatagctttttttactattataagataaggcctgactttttcttacttttttcaatagctgtattaaaccttccaaacggacgcccaagcagcagtccgatcacaagcgatattgctataaatataagaagaatcgcaagatccttacaataatcaaagcggtacatgcctcccacgcactctcttagggcattcatggcatagttaaacggcatgaacttatacagtgctctgtacacctgcggcagcacctcaaccgggaatgtgccgcctgcgcctgccacctgaatgaccataatgactactgctacagcctgtcccacattgcccaaggctgctgtgagtgagtacataagaagcgtgaatacaaggcttgtcagcgcgcttgcgcaccagaaaaggaacggatgcctgcactgtattccgacaaagaacaaatcacctagcactgtcacaagtgtctgaatctggcctatcacaaaaaatgtgatatatctgccaaaaaacttatgtacgctgtttactttgccaagtgattttatatcgtcagtgtcctttacctttgttttcacaagtgcaacagttataagacctcccacccacagagccagcactgtgtaaaacggtgccatggctgagccatatgtggatatctcatatatcttctgctcatccatagacagcggtgatgtcacaaactgcgcaatgagtgtcggatctgtccgaagcagctttacaatctcattaaactgctcatcgtttgacaaattatcaaatcctgatataacattccgcaaaccatctctgatctgctgtacatactgtctggtatttacaatatctgcatttcctgatttaagaactgccgaataatcatcgagtgctttttgtatatccgggaagctgttgtccaaagaaccaagcatggactgggtctcaataagcgcatattctatatcatataccgctcctgtgagatccggtgacacgctgtggtcaaatgtatttttaagtgtatctattgcagacttggcacttgacacatccgcttttatcgactccttaagaatctttagcttatctgccgtcaattcagtatcagacttaaggtcttttatctgtgttttaatgctttggatattatttctgacagcctctatctgcgagctatcaactccctttaagccttgaatggcgacaagagtattctcagcaagctgctctaccgtatcaaagcccgccacggaaacagatatatccgcagtatcggcatcagctaatcccgacgcatttaagagctgtatggagttttccagcacatcgagctgactgtttatgtttgataagcttatgtcgaccatctgtgtgatggtttgtgctgtctgcgcccccgaaagcaccgatgactgcatgccgcttaccgatgattgtcccccgtcaatcagcccctgcacactcggaagcagtgactgtgtcgagcctatcaggctgtctgctgaatccgtgagcatggcaaatgtatcgagcatgcctgcatatgtagaaagagtcgtatccatatcctttagcttatcaacaactgttccggccaggttatcgcctgatttaccgtctcccactatgagctctcccgactttgacgctatctttgtaatcgtgctcaccattgaagagtttacagactgctgcaccgtggtcttgacctttgaggttatctttgttgctatggcatttttcttgctgttttcatagtattctatctgcggattgaccggctcactgcttaggaagctaagcatatcagctgaaaaatccttcggcactataaatgctgcatagcactttccactataaacatactccagtgcctctttactgctgtctgtgaaaatccagccaattgcatcgttttccttcagcccctttatgacactgtctcccatacatagctttaaatcgccgacgctcatcccctcatcctcagaatatactgctatgtgcatctgtgatgtagcttcctctccgtaaggatcccagttggacataatattaaaccatgcgtacaaagccgggatgatgccaagacccataataataactatggcaaccacatttgtagatatgcgtttcaggtcagccagatatatttgaaatatttttttcattgctcggcatcctcccctgtactttgctgcatcgtatcaaatttctgctccactctttcggctatttcctgcaccctgtcctcaatctgcacgacaggactcacactctgtgcatcacagccgcttatctcattcatcttctcctgcagcttatagtccacatactcgactccgattaaatacactgcgatagcaaacagactcactatccacagcacaagaaaaatgatttttgagctatccggcacaatcatcagcagaacaagaaaaaagagcggaatgatgtatatgcaccttaatcctatttttatccgtttttgattctgctcgtgaatggtcttttcatatccgaccagcttatcatacatctcgcgcagtctcttatcatcggatagcggctgctcattcacattattatttgcattattattcatatcattatccatattggaatctttattactgtttctacctgtatcctgcatactttccttcccgctttatagcttacggcacatcagaagtaccatattaatatgccaattatcaatttattaattgtacatttaactatagcatctcagtatcttccatacgcttctctataaaatgattgagtctgataaacggctttcgtatcacaagtcctatcaccaaagaggctgcgccaaaaagtaaaagcgtgatataacatttgccgagtgtgttttcgtacatacctcctatacactccctcatcgcatttatcgcatatgggaatgggaagaaaatatacactgccctgaaaaatgccggcagcgcctctatcggatatgtgccgccgcttcctgcaatctgaagtaccatgacaaccaccgccagtgcctttcctatatcaccaaaggatatggtcagagaatatatgagcagtgaaaatgtaaggcttgtcactgcgcctgtcacaataaatgaaaccggatgcacacactgtattttaagcaggtataaatcacctagcacaatgataaaagtctgtacctgtgacagtaaaaagaatgtcagatatctgccaaaataaagctgtgaaggctttagtttcccaagccccttggcatccgcgtgaacctttactaacgaaacaagtatagtcatgcccacccatatggcaagtgtcgtataaaaaggtgctactccggagccataattggctatctcgtagatataattatctgatacctgcaccggctctgaaaagaagctgccaagcttttcaggattccccgaaagcagattcactatgatatcagctttttcatcctcagaggctgcttcaagcttgtcgagtgtcgtatttatcttgtcagatgctgattctatgactcccttaagctgtgtcatgctcatattaagtgtatcaagcgtactgtccactccgtcaaacacctgcgccatggagcccgatgtctgacttagattgccaagtgtggtctgcattgaatcaagaacagacgacatactgcttatcatgccgtccacctgtggcactatctgtgatgtatatgtatcattcactgctgacgcggtcgatgaaagagccgacattacactcttaagtgtttctgcagaattctgtgtttttcccgataaatccacagactgtgtgctttctatcatgctctttgtctgttccttgacaagctctatattggaaataagtgtgccgacatgggtatcgtccatatccggctttattttgttgattttgtcctcaagattgtcaatattacctttcaaagcatccgctgactgtttaatattttgcacatcactttgaatagtatttacatcctgtgacagatttgcatctgaaatctgctttgatatatcatcaatcgagctcttcacctttgctaatgccgatgtgatatctgcactaaagctgtcgaaggattgtctggtggactgcagatcatttttactctcttcaagcctgtctgtgccctttgcaagcttatcctgcccatctttgagtgcttcgcacgtttctttagacacctgtgacaacgccttatttccgtcaataaacgtatctatcatggcatcgtactgcgcaagactctctgataccgcttcaagcttaccggtcatctgccccacagcatccttttccttcatgtcatcggatattacgttggtctccttaaatacctgctctgcaagcacctttataaactgcttattaatacttgatttaacagcacttgctgcactgtccgttatctttgtcgcaacagcatttttcttgtcgttgagatagtaggtaatccttggattttcaatattgtcagctacaccatgatacatgctgtaggtaaactgctcatctatgacaagtgcagaataatatctgcctgacttaacaccctcaacagccttttcctctgatttaacaaatttccagcctatagtatccttttgctttaatgactctaccacaccatcgcccatattgacagtttcgctgtcattcttcgtccagcccttgtccagattgactactgcaattgctatatttccggtgttgccatacgggtcccagttggcatagatattaaaccatgcatacagcgcaggcagcacgcacagtccaataactataatgagtacaagcacatttcggaatatgccgcacatatctcttttaaaaattcttaaaatatcagccatgaatcatcctcttatatccggtgtttatatccggtgctgtttaagctccccaataaaatacaatgagccaaatgcaacatttttcgtatctcttttcaggtgctttcttatctcatcaactcctgaaagctctgttgcctcaactccctcttttctgataaaatcagcaaggtgcgatgcctgcagtgccctgtctgaatccggtgtcactgtataaaactcctcagcaagaggtaaaatctcacgtatcatggcatcgtagtccttatcagccatgactcccatgaaaaagcaaaatttctcacccggatacatctgcatgaggctttccttgagcgcatcaactccattgctgttgtgtgctccgtccaccagcagaaacggctcctttgatactatctccatgcgtcccggccacacagcctcttcaagtgcactctttatcctgtcattcaggtttgttttctcgctctttggccctgtcttatcatattgaatttcgtattccggcccgctatagtgctttcccagcacataccgcgccgcaagctctgccgctgcagcattctcccactgaaatgtgccacaaagcctcagtgcgtagccgctgcagcgtgctatatcgctttgctccacagtaattatccgtgcatgctttttttgcgcttcctgctcaatcacctgcatggcacgtttatcctgctgttccaccaccactgtgctgttttcctttatgataccggccttctcagccgctatatccgctatatcactgccaaggatagccatatggtcatagcctatctttgtaataacggcacattgcggtgtgccgattgcatttgttgagtcaagtctgcctccgagccctgtctcaatgaccatataatcgcactgctgctcctcaaagtacaaaagagccatggcaaggcagtagtcaaacatcgtaagtcctatgccaaaatctatatcaagcagatagtttccaagccgtgtgacatcctccttagctatcatacgcccatcaaccgtgatgcgctcctcaaaatctaccagatgcggtgatacaaacgtgcctaccctcatatgctctttttttaatatactagaaaaaaaagcgcacaccgagccctttccattggtgcctgccacatggatatacggtattatgcgcttttgctttcctttttctctcagcacctttatgacctgtgctgtcaccaccactcccggctcattgccgaaacggcgtgtgttttctattttgtttaaaacctgtgtgtaatctaaatttcccatgccatcattataatatatccggccgataaaataaagaccatatccttatactgctataataatgcctccgtcatttgcatacatgcttgagatgccggcagtatccacaatgacaatcttcttaaatctggcaagcttctcaaggcatgccttcacatactgtgcacgctccgggcagttgcagtgtgaaattgcaagaatcctgtgctcacagtcctttgtggcagccacaacatcctctaccatcttggcaagtgccctcttaatgcctctggcctggccaagctgctggattgaaccctcatcggttgagcccatgacaggctttatatttaaagtgctggccacaaaagccttcaggttgcttaatcgtcctgcctttcttaatgtatcaagtgtctcaagcacaaagaaggtattcatggaagaaatatactcctcggtctgctttacaacctcatcaaatgaaagtccactctcttcaaactcctgtaccttcatgccgattagtgtctcgcctatagatgctgagcgggaattgaatacatagatttgcttgccacagtcctcatgctcctcgttgtacagattgactgctaaaacagcgctgttgtatgagccgctgagcttgcccgaaagtgtgacaacatatacatggtcagcctctccctcaaaggcctgcatatattcctcaggagacgggcatgacgactttggtccctttacactctcctttactcttcttaagaaatcatgctggtcaaagctctcatcatcgcggattctgtatccgtcaacatcaagctcgagtgccacattgcaaaaatgtccatccttcttaaggctatctgtgagctcaccacagctatctattataatcttatacatatctattcctcctgcactatatgataataaaagtttaaattacttttttaaaagttatttcattccgtaacaagtagttttcattactacgtcatattaacacgaaaactaaacttatgcaagaggtttctgtatttattttcccataatggttatctgccctttaattgtacccgaaaaaggccgtcacacagtcgcttaaggctttcatgtcgcgtactcccataagctcacaggctgagtgcatggcaagaataggtatacctatatccacagtctttaccggcaaaagcgtacctgcaatcgagcccagtgtgctgccgccacggctgtccgaacggttcacaaaacgctggtaaggtatgcccttttcatcacacatctgacatagaatagcaatagcctgcgcatccgtagcatacgactgcgagcacgcctgcttgatacaaaagccttttcccatgacaggcatatttgtgatatccatcttttcctttttattaggatgaagcgcatgagccacatcgacagacaaaagcatggcatcatatatgctctcatctatttcattttctgaaaggtccatatttcttaaaatacgcctgagcatatcgtgaagcattatagaggcagcgccctgcttactgttacttccaatctcctcatggtcaaaaagcgctatgatgtttattccatcagctctgtttccatcctctatcgcatcaagaagagccctgcaggatgactggttgtcgattctcggtgatgaaatcatggtgtcattcacaccgacaaagcaaggctcctccacacaaaatgtattgagctcaaagtctatgatgtcgctcttttccacagacagctctctagccagaaaactaaggaaataatccgtggtcatttcatcctcaggtattgaatcaagcaccggcatcagatccacctgattatttatctcgactcccttattcacatccctgttcatatggatggcaagatttggaataatcatgacaggctttttagacctatatagcaccatacgcggattgaacacatcctcactctttatagccacgcgccctgccactccgagaggtctgtcaaaccatgtgtttaaaatcggtcctccatacacctctacattgacctgtgcatatgagtttgtcataaaatccggatttggctttatgcgaagatatggatagtctgtgtgagctgccgctattcgcaccatatcctttttgttgtagccgcttcctacagtaaacgcaaacatggtcgtatcatggtgatttaagacatacctgccaccgcgcacaagcttccagttacctgtataatctatctcctcaaatccgttttccaaaagctcctgctttgcagccttcacacactcgcatggtgaaacagccgcttttagtaaatcaaataatttttcctgtttcatggattgcctcctgtttttattgcataacgcatttattctaccacggactttacaattattccagttgaacaggctttatttttaaggctatttttatatctatttttatggcataatccgcaaatctgatgtatgatataataatcgataactattcaaaaccacttagaacaatcattcgctgtcacatacaatgtggaaaatgaggagaaattatgatatcaattgaactgacagacacaaaggactttatgaacaagctgcttcgcacagaaatctttgacaacttcctgctccaggaggccgtcatcacaaaggcagcctcatatgtcatagatggtcacctgcaaaagggcttttacagctccacagagcttgaggaaaatggtatagctggctatagcatactcccctttaggatgcttcgcacaaactgctttgacctgataaagggcagacagactccatcgtcattcaagtttgtctttctgctttcacctgaaaacatggagcacaccctaagcagtctgcactctgctttcaccgtgtccgatatcagtggttttttcataaatatcaggtatcagagccagcttctgactctgacaaccggaatatcctacaatattttttcagcggataagaccttagacagtgaatgggataagcttgtaatgaaatttttagcaaataatgacataaactttaaagaactttgactttattgctttacatcttaaacctgttatgctattctaacgttagttgcgtaagcagcattattattatttggaggtactttcgatgagcaaaggtacagtaaaatggttcaataaccaaaaaggttacggattcatcacagccgaggacggaaaggatgtattcgtacatttctcaggacttaacatggagggcttcaaaactctcgaggaaggtgcagcagtagagttcgatatcactgatggcgctaaaggtccacaggcagttaacgttgaggtagttaaataattttgaccactcaggcaatctagtttctatgtacctttttctttattatatatttaggtaaaattatagttacaaaaatgttaattggggaataagatataagaatcatgattaaaaaagaagagttcattttgaactcttcttttttgtgcttttttattgttttggtgcttttagttgtttatgcgatgatgagacatcggtgagcttgtggtgagtggtaaaaacgtgtaaccgttcgcctgtccccactggatgatctgctcgaccgcattgacactgaattcctttatgtcatgctgcaatacaactgatacattatggctctgcacaccggagatgacattctgtaccacctgttccgtgctgattggcttggtgtttgcatctccgctcgatacattccagtcacaatataaaagtcctcttgctgtcacatcatttacgagctgtgtcataatgcccggacaataatccttacttacagtatttgatgagccacccgggaatctgatgattgacgcatcatttcccgtctgtgcctttatgatactgttcatctgctcaaggtcatcaaaaaatgcctgctcacttgtatatatctggttgtatttgtggctggcagagtggatagccactgtatgtcctctctttgcctcctctgctatcatgttctgatagtcaggatgtgtatttgtaacaaagaaggtggcctttacattgtatttatcaagcacatctaatagcccctgtgtatactttccgggaccatcgtcaaaggtaagataaataatcttgttgcccggatttactgtgtccgccgtggcagccggatcatacacactgaccactcttgtagcagtagccttatttcctgatgaatctgagacctcataggtcacagtatactttcccgccttatccttatctaccttatctcctgataccttgacactgtctgtgatgtctccgtcacaattgtctgttgccgtgtatcccggatcactgtacttatcaccctttttaactgacataaaatcatcacccgaaagctttatctgcggtgcagtggtatctgtgacatgcacagtccttttgacctcgctctcattctttgacgagtcagcgacactgtactttatctcatagtctcccggctttgaagtatcgacagctcctgtgacagataccttgcctgtcagatccccatcatagttgtctgttgccgtatatcccgggtcactgaacttactgcctgcctctacagtcatctctgcatcgccatttaatgtaatctccggagccttcttatccctcacctcaaccttgatggtctgtgtcgcagtttttttaccgtattgagcagttacctttatctcgtatgaacctgtctttgtcgcatcgacattactgtctatagtgcattttatctcttttccctttcggtttataagcctgcctctgacatacgccttgatttttggtacctcaaactttttgccatactcaacagtaataccgtttttgaacttgctgctgaactcaatatgtgaatcaaagcatgtgatatacactataaacgccaccaccagaactattgcagccgtaagtatgccgataatcatctttttatttttgtccatttttccaatcctctttagcattttataattattctctctatattattactcaaacctgataatattatttcaagcagtatctattatagcgttaaacaatcttttttgctactgcaaattccttgagaatttcttaatgttggcttcatatatttcagttgtgttacaattgtttctttatcccgaaaacccgtgatagagtcgtaatatgtacttaatttatttaatatctttgttactattcaatttgcaatatgactaaccacttatctttttgcagatattcgcaatcacaaaaatcccccgaacaagtcgggggatttaaaaagcttatgctgtaacaatcattttattactgctccttgcggtgcatctcaaatgtctccatatggtagttggcgatgttgtcacgaatctttctgtcatctgctctgcttaagagatcatcacggaacttctttgtagacaccatgtcattgtatgagcttggtccgcctacgcagccgccctcacatgccattccctcgatgaagttctcaggaagcttgcctgccttcatgaggagaagtgccttcttacactctgctgctccgtttgccttgcaaaccttgcaatcaacatcctcgcctttttccttcatgctctcgattacggctgctgtaactccgcctgagtttgcgaaacgcttaccgtatactgaaccctcctgatatgaggtatcatcagcctcaagctgtactccctttgccttcataatagcacgaatctcgctgaatgtaagtacatagtctgcattgccctctatcttctgatcatgtacctctgacttcttggcaacacatggtccgatgaatactgtaactgcatcaggatcctttgccttgatcattcttgaaactgcacacataggtgaaacagttgtagaaatcttgtcagcaagctcaggatagtgctttctaaccatatttacaaatccaggacagcatgatgtaaccttcttctctcctgcctcatatgcctcaagccactcatcagcctcgtatgctgctgtcatatctccaccgagtgctacctcaacaaaaccgttgaagccaactgcctgcatagctttcttccagctgttcatagtgatatttgcgccaaactgtccctctgctgcaggtgcaaccatagcgtatacatgcttgttctctgacttgattgcatcgattacatctacgatgtatgtctttgatccgatagctccgaatggacagctgtggatacacttaccacatctgatacatttgctctcatcaatcactgaaatgccgtactcattgtatgtaatggcatttacagggcaggagaacttacatggtctctttaaatgagcgatagcgttgtaaggacatgcctgtgcacagcgtccacactccttacacttctgtgggtcgatatgtgagcggagacgtcctgcctcgattgctccgaacttacatgcattgatacaagccttgccaagacagttctgacagttctcagtaactgtgtagcttgaaatcggacaatcctcacatgctgagctgattacctggatgatattgccgtcatcgttcgcgcttggtgctttaccctctgcaagtctgacacgttgacggatgatttctctctccttgtagatacagcaacggaactgaggtgtcggtcccggaataagtgtaaatgggatgtcatctctgatctcatcgaggttacctgcaaatgcagcctttgcgacctcaagcaaaactgcatgtttgattttgattacgttttcgtcagcgtacatattatctccttttccttaaaataatgtatattttgttacctaataaattacatacttagaagaatcattataccatgtgacacttcccatatcacatgacctgattcctctaaaaaaatgctcctagtatttatctactaggaacattctacaaaattttttaaaatttttctacccttgtattcatcaaaatacaaagaattgttatttttttcacaatagcagcgatttcaataagaattactcatggcgcagtgcatcaatagggttcaggttcgctgccttgtatgaaggtagcataccgaatatgattccgattgccatggaaaaaagcaccgcaagtatagctgctgccgggcttatcgctgtcggcgtgccgtttagcattgagatgaccttagagagtatcactccgacaagcactcccaccaagcctccaagacttgtgagcacaacagcctctgtgaggaactgaccgaggattgctccttttcctgctccgattgctttttttagtcctatctctgaggtacgctctgtgactgacacaagcatgatattcatgacgccgataccgccgactagcagtgatattccggcaatccagatgagcatcatgttggttgactggctgagctgctgtatctgctttgcctgctcctgtaaatcctgtgccttgtaggtcacattagagccgtctgtgacatttaagttactgttaagtatctcctcagccgcctttcccactgtagtcatggtacccgtactgtctgccttaagcagaagattctgcggctcatcatagccaaatatgacaggccatgtgccgcttggcacaaatacattgccctggctgttatcataggcatacatatagtaatcatccattgagtttattaccaggtcatagctgtccttttccgtgactacaccgactactgtaaacggatatccctgtatctctactgtcttgccgagcgcgctctctcctgaaaacaggctgctctccacgctctcatcaataagagccaccctgcgtgcatttgcatagtcattctttgagaagcctctgcccttcatgactacatagcttgcagtatcgaaatatccgtcatcgacacatgttatattgccgcccgaaagcgccgtgttcagataatagactgcattggaagcctgtcttgtacggtaaagagctgcatttttcacatggtcgagctcctttatgctgtcaagtgtggcagccgatacctcagtcactcccgccggcgccgtttcatatgataaatccatatcatagccatccttctgcagtgtgacctttacgttattacttcccgaacctatgaggttcttttctatctgttcgtttgtgccctgaattgtggaaacaatcgcaataattgctgcaattccgatgatgattccaagcatggtcagaaacgaacgcatcttatgtgaccagattcccctaaaggacaatctaatattttcaagcatctttaatcctccctgctaaactaatacataccatcttccgacaccttggttttctcgccctccctgactccatacgggaatgcgatatagtcatcatttgtcagacctgactttatctccacatatgagccccagagcgacttgcctgttttgacagactgctttttgagctttccgttgtcatccttgtatatatatgactgtccgttctcggttctgacatatgacttgtcgatatatagtccgctgtcagagccctccgatgatgtatctatggtcaactcaagtgaatcgccctttttgagattctgcggattctcaatgtatgcagtgtactcatagaatgaggagtttggattgctgtctccataatagtttacgctgtctgacggcacattgcttatctcggatatcgtgccctcatatgtatcacctgtcatgtagttgactgctgatacgctctgtcctatttttaccgtatccagatccagctcaccgattgttccgctgatatacagtcctgatgctcccgaaagctgcaggaaaggtgtaccgtcctgcggtggattggcaggatcaccgactgttgtcacaattccatccttctttgcatataccacgccatcctcaagctcgctctgcagttcctttaaatcggcctgtgcaattctcttttgtaaatcaacatcggcaacacttctggtctgctcctttatggcatccttaagctcatctgcagtgtatgtcttttcttctgccgcggtatcagcttctgtctgtgcggtctgttctgtggcactgcctgttttggtacctgacggctcacttccttctgtatcatcagaagaatctcctgctgtaattgtgcctgcaaggaaaagctttatctcctcgctgtcatcatagctgccaagcctatctcctcttacgataagctccatatcaggtgcgttagcatcccctattacaaaccgtgctacagcgcttttatcagcgagtgtattcaaaagctctcccgatacatatgaagcctctgtgcatgtaaatacataaggatcgacctctgtaccgcttcctttagccactgacagatccgatatcacatcatgctcttcgtcaggcttttgctcaggggcagacggctgtgtgtcaggctgtggctcaggtgtaacaggagtctcgggctgcttttcaaccggtttagtgttctttagcttgtcaagcttctgcttttccgatgcaagctggttctcaagactctgtatctcaagctgcttcatctcaaccgagagggaaagactcgtcacatcatatgcaagtagcttatctccggcctttacctgctgatcctttgtgacataaacctctgtcaccttctgtccatcctttaaattgattgtctgacatgcatcatcacacaccattccctcactggtcatggatgtgtagtcgtttgtcgtgctgatcattgaaacactcatgacggaagcaagacccttggagttcctgtaataaacaactcctgtgatgcttcccgctgcaactgcaactacaaggacagctattataatgatcttaattctctttttctttttcattacctgcctcctgtccttcctctgttatctcgccgtctatgatgtggacgatgcgctttgcctgctcggctacctttctgtcatgtgtaatcacgacaaccgtcacaccggactcattaaggctctcaaagagctcaagcacctgcttgcctgactttgaatccagagctcccgtaggctcatccgccagcagaagctttggatgattgaccatagctctcgctatcgccactctctgcttctgtcctcctgaaagctgtgttggcttgaaatcagctctgtctgaaagccctacacgctctaatgcctccatacccatctgccttctgtcctttttgctcacaccggcatatatgagtggcaggcatacattgtccagtgcactctctctcggcatgagctggaaattctggaatacaaatccaattgtatcccgtctgactctcgtaagctccttttccttaagctcactgacaggtctgccgtcaagtatatatgtacccgatgttggcagatcaagacagcccactatattcatgagagtggtcttgccggagcccgacggtcccatgattgccacgtactctccctcctcaatctggagtgaaacatcctttaaaaccggcaccacgagcttatcctggtcatagtttttataaatatgctggagttctagaatcatctactgtacctccgcgtcacctgaaccggtggcatctgcagcaccttcgtccattgtgccatcgtccattgtgccatcatcaacaggaccgccctcagtgccctcaagcatctggtcatcaagagcttctgtacccatatcgtcatagactgaatcttcaccaccgccattttcaacgtactcttcccatgtctgtgccggctcaccctcataaagatcatcagatgcccatactatatagtcatcctttgtaagccctgacttgatttcatacatcatgagattctcgtcataatctccaagctcaacctttgtcttctcaagcttatcctttttattaagtgtccatacatatgcatcatcgccgtcctttacgacatagctctcatcaatccaaataccatcctttacctgcgtctgtccgaaatccggctccacatatacatgctgtcctaaaagcatgtcgcctgtgcctgtaagctgcacatagaagttgtactttgatgccttctgctcgctgcttccatcatcatacatgccggaattgctgttatcagtctgagtattctcagtatcaaccttgctgatggtaccctgccatgtctttgactcatcaactctcgagcgcactataactgcctgcccctctgcgagtccactgtttaaaaagctctgctcatcaattgtgccctttaccctgtaatcaccggtggcaacgattgtcataaatgcagtatctgctgtgtctgcactctgattctcattgattttctttacaacaccaatcattgtgctgtttacagtggcatttttgatgctctcatcatacttttctatctctgccttcttcgtggcaatatcgtactgagtctgcttctgctgtgtctgcgcctgctgaatctgcagtgtatagtcaagctgctgatcctttggcgcttccttcttttccttggtgagctgctctatctgtgcatcatagccggaaagcgtattgtttaagctctcaagctcaagcgtggcgctttcctttttcgcagcaagatcctttgtatcataggtaaaaagaggtgtgcccacctgtacctcatccccctctgacacaagaatatcctttacttttttttcactgtcagtcttgatatccatggtatcggctgcttccacgacaccgctgtacttgtcagtacttcccgcctgatacatgacatcagcgaccttgtttgcatagactcccgatgcctttgctgcattctttccctttgtcattgcaatgacaacagctgacacaatcactgctatgataagcacagctgcaatcactgaaatgattatctttttctttttactcatttcgacctcccggtttcttataattaattgattgattatgaattaatcataccaaatatatattgcatctgtcttttaagatttttttaatattttactaataaaaaatggaggttagtatggaaatagcatttagtgagaaaatttctccacagctgtccgccgccctgttgtccaccccttatgagcttggaaaagagggagggctttcaagcggctatctgccggagagtgatagctgggaagtgatagtaaaatatgtcggtgacatagaaaaaataaaagaaaagtatccttctgtactcatcacgaggctgctcggaaactatgcggtgctcgtaattgagaaatcacttgtaaataccgttgccctgtgcgatgaaatcatatatatggaaaagccaaagcagtttaactacgatgtgtacgagggctctcaggcctcatgcatcactcccgtacacaccaatccatataatctgaccggaaatggtgtgctcgtaggcattatcgactccggaatttactatgcccatccggcttttatacaggatggtgaaagcagaatcgcctatctgtgggaccagactgtttccgatgattcctcacacagtgatatcatccctttcggcaccttatatgaccgcgatacaatcaccaaagccataaatgcagaaaacagcttagaaatgcagcgcatctgtccaagcatcgacatatccgggcacggcactcatgtagcaggaatcgctgccggaaacggaaatggtaatgataatgaacaaaacacaaaataccgcggtgttgcttatgaaagcactcttataatcgtaaaactcaaaacttcaggcggtgccagctttcccacaaccacgcagattatgctggcagtagacttttgcataagaaaatcaatcgatatgaacatgcctatcgtcataaacctaagctttggcacaagcaacggctcgcacagcggcacctcactgcttgaagcatacctggactatatagcaggaaactaccgctgcgctgtctcagtcggctcaggtaacgatggagccggctttggccatgcaaacggcagctcgtaccctgccgatgcagagcttgcgataggctatcctgagccgtctctttccattgatttatggaaaaaatactgggatgagatacagctgcgcattagtgcaccaaataatgatatgctggagattcccgatacaattaccaatcaggcaaagggctttacatacagatacaggctcgatgggacagacatatatataacaggcggcggtccctctccctactctccttttcaggaaatattcattgaactcatgggatcggaatatatctcacccggcatctggaaaatatcacttgaacccatatctgtaaaggacggctcatgggatatatggctgccgtcaggtgccctgcgcaatgcacagacctcatttatccatgcatcgcctgatatcaccctgaccatcccctcaaccgctcaaaatgtcatatctgtcggagcctatgacagccaaacaaaccgcacagccgccttttccggccgaggctatacctgggcctttgacaacataaagcctgatatcattgcgcccggtgtagacattatttcatgctcaaacacaggaggctacacttcaaaaacagggacatctatggctgcaccgtttgtaaccggtgcggctgcgcttctgatggaatggggaattgtgcgcggaaatgacctctatatgtatggcgacaagcttaaagcctctctcataaaaggtgccggtgaaaatgtatttacaactgcctcaagggctgtctctgaaaacacttccaaaaacacaaaataccccaaccctgttacgggctggggtacattgtgcttactggatagtattccttagtggaagcgctattcgtatacatgcttctgatgcttctttgcatctgccttattctttttcttcaatggatgctttgggtttttatccattataatcgcttccttccgttcgttctgactacgttatacacctgcaatcagcacttgtcaagcaagagtgctatttttaattaattatttatatttaatgcaaaatcgcaatcattttgatgtcaaagcatcgatttgtatgcacaattattgacagtttgctaaatttaattattatctcttcatcacactctttttaaacacagtcatcgcaattcaaaaatacatcattacatagctgccaaatatacaaaatatgccgcatagcaaagcagcatcaccactccacatggctttctaagctctttatgtcttatcgtacctccccacagaagcacaccgcacaggattgccacaactgtatcaatcacaaacctgctctcaaacggtaccggacaaatgagagctactgttccgattacaaagagtatattgaaaatattgctgccgactatatttccaatcgctataccggcatttcccttgcgtgctgctgaaacagatgtaacaagctccggaagagatgtgccgaatgcaacgattgtcagtccgataaagcgctcactcatgccgcaggctcttgctatggtcgtggcaccgtttacgacaagctggcttccaattacgacgcacacaccgcccagcacaataaagagcagacatttccataccggatatagctttaccgactgctcatcaccgctgtcattgcccttttttgccagaaaatacaaataaagcagatatgcaataaataaaatccacagtataacaccctcaatgaatgtgatttcattgcctgtcattcccatcacgagaagcaccgctgtgataagaagcatgtacggtatctcgtatttgaaggtggttttttgtatggctacatttgtgatgagtgccgtcactcccaggattataaggatatttagtatattgctgccgacaatattgccgactgtaatccccgcattaccctttattcctgcagtgatgctgactgccgcctccggcagcgacgtgcccatcgccacaatcgtcagtccaatcacaagctgcggaataccaaatttcccggcgagcgccgccgctccatccacaaacacatccgcgcccttcaccagtgctacaaagcctgctataagcagtaaaattgctacaaaaatcataattttcctccttctgctgtcctttttaaggatgcctgattaattgatagttacagctatgtcctatcagcagaaggtttttgtatacaaaaaaggcgacacttctgctgtataaaacaacaaaagtctcgccatttaatcactctccggattgctgtcatatatgtatgatatgtatgagcaatcgtactgacggataagtaagcactctcgtgccggctactccctttcacttatatactatgatatgtcaacgcagtgtattcgtcaagagaaagtttttcttgcctttatcacgctaacgtggtagcatggttactaaataaactattaaagaggtactacaaatgaaaacatcagaaattattgtatttatcgtctatctgctgtgcatgctgggtatcggtatcttcttcttcgtgaaaaacagaaacggcggagaaaagacctacttcctcggcggacgtgagatgggaccatgggttgcggcgctgtcagccggagcctcagacatgagtgcatgggtactcatgggacttcctacttctatctatgcactgggcttaggtcaggtatggattcctgtaggacttgcaatcggctacactataagctggctgctagaggcccctagactgagaaaattctcgattgtagcaaacgactccatcaccattccgcagtatctgaccaacagattcctgtccaaatcacttgcactgcaggtgatttgtgcaattgtgtttttggttgcatacactatttatgcggcatcgagcgtaaaggcatgtggtactcttttccacactgtaataggaatggatccacagattgccatgtatcttgcagcagttgtcatcgtaggctataccttcctcggcggcttctcggctgtatgctggaccgattttttccagggcatgctcgtgcttggttctatgtttatagcaccgatttttgcagcatttatgcttgatacatcatctatgtcagcactcccgggcggttacttaaatccattctcaagctggcaggatatcgtgtcaggactggcatggggacttggttactttggtatgccacatatcatcatcagattcatgtccatcaaatcacagaaggatttgaaaaaatcagcaaaaatcggaatcacatggactctgcttattgtattttttgcgactttaatcggagtaatcggaagacttttccttggctttgacgaatcaatcaatgaaaactctcttgttttcatccagattgtaagaaagattttcccgggtgttatctcaggtatactcctctcagcagtgcttgccgcttccatgagtaccgcagacagccagcttcttgctgcttcatctgcattctcgagtgatgtgtacaagcctgtcatcagaaaaggcaaggcaagtgacaaagagatgatgtggaccggccgtattgtcgttcttggaatctctgttgcagcactcatcatcgcatcaaaccctaatgccggctctatcatggcacttgtttccaatgcatggggtatctttggagctgcctttggacctgcaatcatgctcagcctcttctggaagcgctttaacttcaagggtgctgttgcaggaatcataacaggtgctgccgttgatatattgtggtatgcattcctcacatcaaccggaatctacgagctgctgcctggatttgttttaggacttatcgcagctgttgttgtgacactttgcacaaatgagccttcaaaagaggtttatgagctcttcgataaagccgaaaagtttgatgaataattaaagtaattaatcagtaaagcacataagtaaaaccgtcgtaccctgccatttacggccccggtacgacggttttatttttcttatgctttatattgtgcttttagaaacactgctatgcctgctcctttttgcggttcataagagctgcgattgatacgccaagacctgtcattgcgataacaagccacatatacatattgctgtcatctgaggtctttgctgcgcctgcagcagctgctttagtacctgcattggtatttacctttacaaaggcaaatgtgctgaaatggtctgtctcaaatacaagctttccatctgctacccttgatgtgcatgctataagcttgtctgaatctacacggaacacattgattgcctcattgtcagctaatgcaaacggcatatccatagttacctgaaccttgtctgcaagctgatgaagctgtgtagtgccatctgtcagattaagctcatatattaaaacatcctttactcctacaattttatcctttactacatctgcaacctttgccacttccttctcatcagttaccttctttgcctcgaattttactgtatccggaaggattcccttagtgtcctttacagttgttttggtgtcggatgtgcttgatacaaccgctcccagtgtaagaacctttgcaggctgtgtggtcggtgctgttgttggtactgttgtgctgcctttgttggcatcatctttgtctgtgccattatccttgtcagtggtagtatcaccgctacctgtattgtccttgttattatcatcagtagatggggtatccggcttcttgttttcatcatcaccggtattaccattatcggcatcactcttgtcagctgactttgtctgatataagtataggtcatcaactgttccccagccaccttttgcactcacgataccgacaacaagtgtaactttggtttctttctcaagcttaaatgaaacgcttggagtcttccagtttttccagcctgtaagtgttacattgtcaccctttgcaatgatattgccttctgaatccataacctcagcataaagctcatctccgtcggctccctgtcctacatactcaaagatgtactcgcctgaagcaagtgtaatagctttattgtaagtaatggcagcctcggtcttatcttctccaccattataccagtgagcacatgcttctcctgacttcttatcatccttggtggaagaaactgaatcgacaatcttgttattgacagtaaaattatcagccttttcaaggcctgcatcatctgcatctgtaataagatttttctgctttataactactgtacattttgttgtaccggatgtcttatctttataagcaccacgctcgatttttctgctgaatttgacagttccctctacagtgtatgttcctgcctttgaaaaatcaattccctctgtattccaaacaacgttctcttcaaccttttcggtattgtatgtcacattaactgttttgggaagctctatctcttttcctgcctctcctgtgacatttgcagtttctatatcctcaactccgattttggttacctttgcaccggtctttacgtaattccataccttaagacctgctgttgctgttccatccggataaaacattgcctgattgtcaacagcggaacctccataccattttcctgcatcttttggatcatactcaccgctgtagcttgatgcccagcctgagcccttttcctcccaaatctttttatttgcttcatatcttgccgctgcagtttcctctgaaagacctgtggtatctccaactgtaatccatgccggctcccagtaatatacaccaagtccacctgcttcatttacagcattgatgagatttctcatgaaagtagcctgtccctgcacagtgaaaggctctgtggcatctgccgagtcatcattatttccctcacgaacagtatttccatgaccatctgaatcatcaagtgtatatgcatagcttgtttctacaaccattgcatccttgttgtgcttcgtctgaacatagctgagttctttctttaaattgctcagtgtaccatgccagtatggataatagctcgttccaagaatatcataatttacattatatttttcaagattatctgaccacgttgtgagtgtattcttctgtggactttccacatgaatcacaacctttacgtcactgttgtaatccttaacaccttttgagcctgcggaaaagagcttgcacatggcttgcgtatttgtttcacctataaaaccgcctgttgtctcgtttccaacctgaaccatatcaacaacatcctttgatgcatcaattgtgtttaatgattcattgataaacttttctacagctgtggctttctcatcaactgtatagcccttccatgccttaggcaccatctgtttactcggatctgtccagaaatctgagcaatggaaatcaacaagcatttttatgcctgcgctgcggcatgcatcagcaattttctttgctgttgccacatcgttatttccaccaccatatccgtttccgtttaaatcatatggatcattccatactctgacacggatatggtttatgccgttttctgccaggaatttgcagaaatctgtcacgttgttaatttcttttccgctataatccttgtatacaacaccactgcctaattctgttataacagatgaaatgtccattcccattatgaaatcaggcgacaaatcctttacctttgcaacaacaatatcgtcattgtctactgagttatcaatttccggcgcctttgatgtaatagttgtacatacagaaccaagctcattgccatcagcatccttaagctgggctacaacataatacttaccggctgactttgttgtgtaagctgccttaagagtttttccggaaccattgtcattttctaatgttccgtcactcaatccatctgtgtgatcattccatgtatcaacccaccaccataaatttactttctcaggaagttcacttatttcttttccatcataagtaatctttgcttcaagattaactgtatcaccattttctacggctacttctgtctggtttactgaaattgtgtagcctttctggttttcttcggaagagtcagtatcatctgcttttgtttcataaagcttttgaagcttaatattgtcaatatcgccccaatagccgttcgtaacatctcctccaatacatatatcaacatcttgtacagcttcaattgtaaattcatcggttgtaactgtttcccaattatcccagtctgttgtagccggaagttctttagcctgttccaaatatttcacatacaggcctgatttaacatctttttgcccatcctgatcaattgaaatcctataggttcccggctcaacattcttgattgtttgagatagcgaattgtccccagttatgtcctttatctttgtaaactgagttgtattatttttcgcccactcatcttttgtgacaaatagtccacttcccgttgacttagtccaaccggttatacttccatccccatttatagacgactcaaagtctccattcaccacatactctgtgtctacccactttgcggtattctctgctgccttaacctgctctgtacccaaatccgccacagcgctctggcttaaaagcattgcaaacaccagtccggcacttgttatagatgccatttttctcttcctgctcatattttcctccttgtttttatgcagtggtaaatgactatcaaattgataaatatcaaagccattaagccactgtcatgcacctgctcaaattgcatgccgcgcatgatttcatctgttccatgcgcaacagcgcaatcggttgcaataactatatttacagtctatacatttattgcgtacgtttcaattgacataaatgacaagttatttatgaccaatttagcaaaaatacatcaatttaatatttgtaaatatgggaaaatatacaaaaattcagattgttcaaacggttattcaagaaatgacattcacattgattttgtggaaatttcacaatacttttacgcgtttagaagtataataattttttatgcaagctaaatatattaatatgcatcataatttttagtttttttataggcaaattgccagagtccacggtactatatataaaaaagccgtacagcagctttttaatttaatgtctgtcaacgcaccaccaaaaaaacctagcattatctgctaggttttttatcgaaagtaatgcctccattacttagcgcccttaagggcatctcatttgttgtgtgcattatactactaattaataaaaatgtcaaggaaattataaaaaatattttgtttcaaataaatctatattccattttttatagtctccgcatcccattcgtgctaatattttattatatactgttttccccttttttattcccatactaacctatattttaaattttaatgtccgtaaaggtttctttaatgcagatacgtcagtaaaaaagcttaatattttaattgaatcaaataattttaacaccgaatctgcatttttaggtgttaatgaaaacgaagcaattaataatgcattaattcgatatcttttttcagtccgaaatctattaagtagcgtcgtatgtgcacagttatttctaagacataataaaatatcaatcatatttaagaacggggcacgttttgataatggtaaattaaaatcatttaaaacatctttaagaacatcatcttgcaaatagtgcaacagtcttaatatttcaccaaatgtaagagtctctattgcaacccaaaatggcacagcgatgtttctgttgtaagtgccatcactattacgataaacagcaacccctgaaggtgctacgtaatcattgtctaaataaaatgaaatatcaatatgatcatttctatctactaaattagatagaaaaaatggtttaaaaagacaaaacttatcaaaatcttgatatatcttttgattttgataattaacaaatggatatgcttcagaataatgacaatatgtcggtgtcccagattctttgtttgcagggttcataaaattagacttatttgtatattgcattgtatccgttaatgaaacacaatgatgcttacaaaaattatatgctattgaggcttttaacttctcttcaacagaatccaagcaatttgataagattgatctaatttctttatcaaattgatatagattaatgaaatcaatcaactttactttatcatatgttttaggagaggatgtttgtagaaaaatagtttctaggccattaaataaattaaaataattatgagaaattaaaacttcatcaagctcattttctgaaaagataagttttctgttatgtaatttattttttaatgcttcgcgtgtttcaaatgttttaatccccatagtttaaaaactacctcgtatatatatgaataaaattatttttataattaatattataacacttttgaatgcatgaatatagacttatttacaaaaaagccgtacaacagcttatgaaatattttcaaaagctgccatacggcatatttttatgttacatcaggctattaatgtaatatatctcttttttcagaacactaatctcattctcaagtgcattcttctgtttcgtaagcttttcagattccctggcacatttctcatatttttctgagaatttctgcttataaagcattgcattgtttacttccctgagacgtgcatacatatccatttcaaattctgccttgcggcactccacgtcgagcctgtcatattcgctttgcagctttgaaagcttgtctgtacgctcctcaaggccaatattccagatttcttcattagtcataaacaataacctcctttaacttctacagatgaagcactcgctctttaatctcctgggttcttccctgattccagaactgtgtacctatatagccgcatgtacggcgggctacgctcatcttattctggtcgcggttgccacagtgtgggcactcccagatgagcttgcctgagccctcttcctctacgattttgatttctccgtcgtagccgcatacctggcaatagtcgctctttgtattcagctctgcgtacatgatattgtcgtaaatgtactgcattactgaaagcactgcagggatattgtcctgcatgtttggtacctccacgtagctgatagcaccacccggagacagcttctggaactgagactcaaactttagcttgtcaaatgcattaatctgctctgttacatgcacatggtagctgtttgtaatatagttcttgtcggtaacacccttgatgataccaaagcgcttctgtaagcacttagcaaacttataggtggtagactcaagcggtgtgccatatatactgaaatcgatgtttgactcctttttccactgctcacatgcatcgtttaagcgctgcattaccttaagtgcaaacggtgttccctcttttggctctgtgtgtgatactcccttcatatagcgtacacactcacaaagtcctgcatagccgagtgagattgttgagtatccgttaaataataatgggtctataacctctccctttttcagacgtgcaagtgctccgttctgccagagaatcggtgctacatcggatttggtaccaagaagcctcttatgtctgcacataagtgctctatgacacagctcaagtctctcatcaagtatcttccagaatttttcctcatccttttctgatgagcatgccacatcaacgagatttaaggtgacaacaccctggttgaaacgtccatagtatttacgcttgtttggatcaaagttctcggcatgtgccacattgcccgctgtctgtgagcatctgtccactgtgaggaatgaacggcagcccatgcatgtatacacatctccgtccttaagctccttcatgaccttctctgaaatatagtcaggcaccattctctttgcagagcactgtgccgcgagcactgtgagattccagtactttgaatcctctgtgatattatcatcctcaagcacatatatgagcttagggaatgccggtgtgatatatacacccttttcgttctttacaccctttattctctggtgcagcatctcctcaatgattgcggcaagatctgcctttgtctgcggatcggatacctcattcaggtacatgaatactgtgataaacggtgcctgtccgtttgtagtcatgagtgtgatgacctgatactgaatcatctgcacaccacggttgatttcctccttgacacggagctctgctacctcgttgattttttcttcatctaaatcaaggcctacgctctcgaattccttttgcacctgctttctgaacttctcacgactgacctgtacaaatggtgccagatgtgcaagcgagatactctgtccaccatactgtgagctggcaatctgtgcgatagcctgtgtagcaatgttgcaggctgttgaaaagctctttggtgtgtcaatcatagtctcactgattactgtgccgttctgaagcatgtcctcaaggtttacaagacagcagttgtgcatatgctgtgcaaaataatctgcatcgtggaaatggataagccccttctcatgagcctccactatatcctcaggaagcaggaaacggcgtgtgatatccttgctcacctcacctgccatgtagtcacgctgcacgctgtttacagtaggattcttgttggagttttcctgctttacctcctcgttattgcactcaagaaggctaagaatctgctggtccgtagagtttgacttacggacgatggctctcttatatctgtaagtaatgtagtttctggctacggtaaaggcacgcttgttcatgagctggttctccaccatatcctgtatctcctcaacgcttggagagcgcttcatgttctcacatgcagtctctacgttgcttgcaatttcttcaatctgatcagcagtaagcttctcatagtctagcactgaatcgtttgcctttctaatggcagctacaattttggctgcatcaaatatgtcctcactgccgcttcgcttgatgattttcatgtaaatttctcctctctgtatactatatttcatataatgtagtgtactatatatagtgttgttattcaatacacatactatatatatgcattttatcatgtgtaatggcacaaaatatgcagctataaatgagatgtaatcattaattcatgtcactgccctgcaatgtaaagcgggcttttcaccaaacaattacaatatagctacatataaaatgccatattatttaatacaaatctgtgcatctgtcttttgatgacaatctaaattatacaagatattgttgctatgtcaatacgctcaacaatattttgtagcattttgacttattgcacaaaaaaagccacaatatttatgctactttttcaactctgtaattattttgttacttgttaagcttttccatattgtcaatcactctgtccaaaaagccaagcatcatgttaaactcctccttagaaaagccttcgtgcatggcttcctctattaccattatattttccctcaccctgttttcatggtccagcgctttttgcgttagctcaatcctcttaagccttgcatcattttccataggtgtgcgcacaatatagccgtttttttcaagacttttaagcatatttgtcactgtggctcctgacagatgaaactttgcttcgatatccttttgaaatatattttggccctgattatccattatatatccaatcatcataccctggcttcgcggtatacattctgttttactgcacctttttctgtcaaaatatttgtctatattcctgctgatgcggtttatcttgtgtcctaagtatttatccggtgtaaactccttcatatctgaaatcctttcatagatttttcttgacaataaaaaaagtatatctataatatagttagcacactaactaattaaatgcaagtatttttttagttaaccacattaccataaatgtgtgaagtttgttttaatcaaatataaaatataagaagaaaggacaaaacatatgttaaaaacactaggtgcccaaataaaggaatacaaatgggcttcgattgcgacacctgttttcatgttgcttgaggtggctgtggataccataatccctcttctcatggcatcaatcatcgacaacggtgtcaatatgggcgacacaaggcatatctatatcatgggtgtgtggatgattgtcgcagcactgtttggtcttttgacaggatgtctcggtgcaaaatatggtgcaaaggccgccatgggctttggaaagaatctgcgtgctgcaatgtttcgcaacatccagaccttttcctttgcaaatatcgacagattctcatccgcgagtcttgtcacacgtatgacaaccgatgtgaccaacatccagaatgcttacatgatgctgcttcgcatggctatgagagcccctgcatccataatatgtgcgatggctatgtcatttttcatcagccctcgccttgcgacaatatacttaatcgctgtcattgtgcttggagctttactgcttttcatcagcaaggcggccatgaaatacttcgacagagccttcaagcgctatgatgacctgaacgaaagcgtacaggaaaacgtatccgctatccgcgttgtaaaggcatacgtccgtgaggattatgagaagaaacgtttttcaaaggcagcacagaatatctacgacgtatttgtgaaggcagaaagccttgtggtatacaactctccactcatgcagtttacagtgtatgcctgcatcctgttaataagctggctcggagctcatatggtggtaagcagcactctcactacaggtgatctgatggcacttctcacctattgcatgaatattctgatgaacctcatgatgctctcgatggtgtttgtaatgatttcactctcactcgcatccgcaagacgaatcagcgaggtattaaatgagcagagcacactgcacaatccaaaggaaccgctttacgatgtgcctgacggaagcataagctttaagcatgtaaccttcagatattcagacaccgctgaaactccggttctgtcagatataaatctagacataaaatccggtgagaccatcggcatcataggaggaaccggaagctcgaaatcttccctcgtaaacctgataagccgtctctacgacacagacaccggctctgtaatcgtcggaggccacgatgtgcgtgaatacgacatggacactctcagaaacaaggtagctgtcgtgctccagcaaaacgtgcttttctcgggcaccatactcgaaaatctgcgctggggtgacaaaaatgctaccacaggtgagtgtattgaagcctgcaaaatggcatgcgccgatgactttatcgtctcctttcctgacaagtacaacacctacatagagcagggcggaaccaacgtatccggtggccagaagcagcgtctgtgtatcgcaagagctctgcttaaaaagccaaggatacttatactcgatgacagcacctcggctgtagatacagcaacagattcaaaaatccgtgctgccctcgcaaaaacaataccgggaaccactaagctcatcatcgcacagcgtatctcatctgtcatggatgctgaccgtatcatagtgatgaatgacggaaaagtggacggctttgacactcacgaaaatctgcttaaaaataatgaaatctaccgcgatgtctacgattcccagacaaacggcggaggagactttgatgaaggaggtgctgcctgatgccaggaccaagaggaccacaaggtccaaaacccaaaattaaaaatcccggtaagctttttgcgcgcctcatgggatttattttcaagaaatatttaccggcctgcataattgttgtgatatgtatctttgtcagtgtacttgcaaatgtgcagggaaccatgtttaccaaaaatttgattgatgactatatagtaccactgcttaagacaggaagtcccgactacggaccactccttgcagcaatgggaagagtcgccatattctacggcatcggcgtcatcagtacgtttgcatacagcaaaataatgatctacgtatcacagggcaccattaaaaatctgcgtgttgagctcttttcccatatgcaggatctgccaatccgatactttgactcacatgcgcacggcgatatcatgtcaatttatacaaacgatatcgatacactccgccagctcatcagccagagtcttccgcagatacttaacagtgctatcactgttgtgagcgtttttgtttcaatggtcatattaaatattccgctcaccatactaactatcgtgatggtaatcgtaacaacagtcgtgacaaagaaatttgcaggcttctccagccgctatttccttgcgcagcagcgcgacctcggcaaggttaacggcttcatcgaggaaatgctcaacggccagaaggtagtcaaggtatttacccacgagcaggaaaatattgaagccttcgacaaaataaacgatgaactctttgaaagcgcctacaatgccaacatgtactccaacatgctcggtcctgtaaacgcacagattggaaatctaagctacgtgctctgcgctcttgccggcggtgttatggctctttcaggctttggcggtctgacccttggtaagcttgctagctttttaacctttaacaagagctttaacatgcctatctcgcaggtcagccagcagttcaacagtataatcatggcacttgccggatgtgaccgtatcttctcactgctcgacgaagcgcctgagactgacgagggctatgtcacacttgtaaatgctaaggaagaaaacggaaaacttaccgaaacacctgagcgcaccggcttatgggcatggaagcatactcatcaggctgacggctctgtggactacaaaaagctcgagggcgatgtggtatttgacgatgtggatttcggatatgtgcctgaaaaaattgtactgcacgatgtggatctgtttgcaacacccggtcagaagattgcctttgtcggcaccaccggagctggaaagactaccatcactaaccttatcaaccgcttctacgatatagcagacggcaagataagatatgacggcatcaatataaacaagattaaaaaggctgatctgcgccactctcttggcattgttttgcaggatacccaccttttcacagctactgtcatggaaaacatccgctacggcaagcttgatgccacagatgatgaagtatacgcagctgcccgcctggcaaacgccgatacgtttatccgccagcttcctgacggctacaatactgtactgacaggtgacggtgcaaacctaagccagggccagcgccagcttcttgccattgcgcgtgccgctatcgccgatccgcctgtgctcatcctcgatgaggctacaagctcaattgatacacgtaccgagcgtattgttcaggacggcatggataagctcatgcatggccgtactacatttgttattgcacacaggctttctactgtcagaaacagcgactgcattatggttttggagcagggacgcattattgaaaggggaagtcatgatgagctgattgcaaagaagggaaagtattatcagctttatacaggaaagactgcttaattcagtatcatagcatgactacgaaaaccgggagaccgggaacgcagccgggggatggcacaccctcacgtgcgctaacgctttgctgttaagattctgtacgaattatgcttatagtgtttctatgcttgacgaaaccggcttttatgcgccgtccatggcgcataacaccttgcccagccatccatggctgggcatttctgtgtttcatgtgcataattctacagtatctaaacagcttcgctagtcgcttacatgagggtgtgccccctgctgcgttcacggtctcccggttttcttacgctgtgactggatgttcatttgtgtacgctcttactctgcagcaaagcaaagtaatcataccttttatctttctacaagcactttgcaacttttttcataaaaaagaaatagtacagggctttctgatgtagaatgagtttgaccacgaggctattacaattcattgcagtacaatgtacctgtaacagttcttccagacaatcatcataaaccagatttacggaaattctgccatcttcaaacacctgtaccttgtcaacaaatgcatctgccagctctttgttaagctttctgcatttcagatatttattgataaggttttcccagtcttcatcaatcttataattctttgaatacaggttctgagatactaaaagattatcaatctccttcttcaaagcttcgctttttaaaagatactgctgttttaatgtcagatattcgctctcattaatcaaatgttctgaataatctccatataactcagagaacttgcggtttaccttctccagttccctgcgctgtctggtaatggctttttcatacacatcgtattttttcagtccgctgcttcttgcatttaattcccttattactcttaatgcgtcaatacagcaacgcatatgatttgaaatctgagcaaagacagctttgttgacatcctcctgatcaattttgtgtcttgaacatgccggattaataccatctgaaaaagttccacaaaaatatacatacgatttttttgttcttggagaaagtctcattcccttgccacagtctccgcatacaatttttccctttagtaaattcttttcattaggtgggtgttttgtaaactcttttgcaaaataagcatccgagattttctttactctttcctgtgccttttcaaatggctctttgtcaacaagtggctcatacgtatttttaacaatgacccattcacttggatctgttgcatggagtggaatattattgtatttctcaattactactttcccatgcaccgccgaaccaatgtatgcctgatttgtcagtattgacttaactgttgttttggtccatacaccattggtttttacattctgctggtaaccaagagattttaaatacatcaatggtgacattattccttgctcattcagatattttgcaattgatgtatatcctttgcataaaactcatttacgatatttttcaaaggcatcataaggtctgtgcccggtctgaacgagtcaaaatcatccgtaacagcaatgaatcttacattgagaaaaggaaacactctttcaatgtagttccccatctcaacataatttctgccaagtctcgataaatccttaactataatacagttaattcttcctgtttttgcataggtgcaagtacaccctcaacgatatatgaaacaattcagcaatactaatcaaagtatctatttttgctccatttacaccagcttcaatttcccgcagagcatccactgacaatccaatctgctcggcaagctgctgtcttgtcattcttcttgccgcacgcaactcttttattctttctccactattaacaatatcgtagtacaccttccactcttttccggcaccttatatatttgcttaagctgtattcattgtaccgtaagcgaatcttttgtaagagtgactaaaccagctatttcaggtggaatattgtacaccttaataccaagaatataaatatttgcggattaaaaaaagagatatttccaaactctcattacattttggaaatatctctttacttaatatcctcatccggcacaaactccatgatgtcctctatcttacaatcaagtatggaacataatctgtttaggattaccgtttttacgaccatattctttcgcaatcgctgtaactgtgctttatctattccataatctttaattagtgcatactggctaatattttcttcttgagtgtgatccataacctgtcatatactatcattacaaagacctcctccttgtattctacgcaagagtgtcctataatgatatggcgtgtgtatgcaccatactgtatgtatatgatagaatagaaaatagccctcaaggttattatgtaatatagaacggattatctgttttacttttatggtattcaaccgggacaattcaatcacctgacaatttgcccgcagatacccttttcagaagggattcacaacaacactatgaatgataaaaacacatactccgttgataaatatttggaaatcattgccgaaaaagaagaaatcacaaaagaagaagtccaacaggaaattggacgggcagtttccattgctttaaaaagccctgatccacaaatgcaacgcttctggacagactttccatgtgaaaatgaaactcccaccattgaagaaatcatataccatctcgctgaaaaatttgcaaaagagtcatagacaaaggacaggataactacccgtctattcactcagataatcttcctgtcctcttaatatttgttcaatcatatgtaatgcaaattctatttctctttcgtcacaccgattcatcataaatgcaaaactctcaatgtgtttttctgggtgctgctggctcatcagaaccataggcgatgactccaatgcatgaacaatattcaaatatgtatcaagactcattgcccttctgccattttcaacacttttgatagtatccaatgatacatccgcccgttctgcaagctctgcctgcgtaattccaagccttcttcgttcttttctgatattctctgcaataattttgtatatgtgctctcttttccccatagccccatcatcctttctgacttatcgcattatatcagaaattattatggtttttggtaaactgtaatcctttgacattttcgtgtaatactttgcagattttactatctcctgtcaattcatggcaatatattattcaatatttttctcccatattcagcatatttttaaattccagattatcttttgacaaatcatcatagactccacttccaacaacagcaccatctttcagcataataatctgatctgcttcttttaatatctcctgtttgtgggtaatgattatgaccatcttttctttcagtttcgtatggagcagtccgttaatctgatgttcggaatacacatccgtattagatgtggcttcatcaaatataataaccggactgttatgcaccaacgcccttgccagtgcaattttctgtttctgtcctccggaaagcattgccccattctgtcctaccacataatccaatgacacctcagaaataaaatcagcaagtccactatctttacaagcttccataatgaacttatcatctatatctttatacatacagatattatccctgatcgatgaattgaacagatagatatcctgacttaccaccgaaaccatgtttctataatccttcaatacaagttccgaaatatccgtaccgcataatgttattttaccacttgtaggttggtataattgcagcagcagacttatcagtgtgctttttcccgaaccattccgaccaatcagcaccgttttacttcccttaggaaaagatatattaacatcagacaataccgctttgtccttttcatatgaaaaagaaagattctgtaattccagatcaccgaagcaaggctctgtcatactctcctcattttccttttcttcttcaagtgccataaactcataataccgctttgctgaaggaataatacctgacaaaagatacccgatattgagtattgctgaaataggtcctgtcacatacgcactatatgtaataaacgcaaacacacttcctactgaaagctgcatatcaaaaacaagatttgcaccaataatatatatcaggctggtcagcagatgtacgataatgttatccgttatgccgttccactgggcaagcatattcatctttttctgtttattgattacagaaagctgtctgtcagcaaattcggctctcttattttccagtattccaaaaagctttacttcccttacaccgccaacagtgtctccaaaccatccggcatatttctcgctttctgtaataaactcgtccatgattctttttcgcttctttgcaaaatgcttcataataaccgcttttaccggaataaaaagaagtaccatgagtgtcattctgtaatccaggataaaaagcccgatgattccacctaccatgctgaatgcctgggtgacgacaaaaaacacaccctcatctgcaatagaagtcatgttgcctatatccacatttatgttatttaggatttccgcataatttctattggtgaaataatccgcttttattttcatcagatgcttaaacgactgttccgataaagaatattgtatattcgcagatatatctacccgtttcttttcttttataatatctataactgctataatcatataaataagcaatgagcatattacctgttttataagcagttctttgtctccgcctatgaaaccatagtccataatccctcggtttaataacggaatacacatattcaatcccgttgaaatgagcagacatgcaataatcagtgcaattatttttctataatcctttagcagccccagcagtttctttactgcttctttattcctcatcttcatcctccgtcaggattgtaagcaaacaatcatatactttctttatctgctgctctccgagggttccaaaacacatctgtgtcttttttattttgtcgcaataaatttgtattcctgtctgcttcttcccattttctattcttacaaatatatcggcttccacaccgatgctttctttttcctgtattccacaaataatcaaatcagactggttgtaataagtctgccaatacaggaaatcaccaatcttattacttatatcttcatcaacagcaaaagggatatattctaaatcatacaatacgctctcctgttcagtggaaatagcatacgcattatagccctctgcttcaaaacactttcttaattccgtaagccaccatatctgatcctgctctttatcactttttataagtatgacaggtatattgatgctctccttctttatccttgaacataagatctgttcttttctgtttcttctgctccagaaaaagcactgtgtatccggctgctctgctatttcattgccaagatacacaatgtgcttctccctgtattcattaaactcatttttatcatacaaaattacagtgtctgcttcttcctttgcagctacctcaaaataaacctctgccttactctttaatacctttccggcaatccatcctttttctatccaatccggaatatattgtacacattttcccctgaatttctggtataaatgcttcttaatctgccatacattattgatccatgactgttccatcattaaccttccagccattgctgttacataaggtgccgcatagctgttacttttctgaagcgttatatcgtttcctccaaaccagattttgtgttccgatggagctgcaaaatccacacctttatcccgcaaaccttccgcatcaatgttaaatgtatcttttgcttttactccgataacatttgaaaaggatgccgggaaagccgtatacccactgttagcagttgccgcaattatgataagtcccttattggcatattgatttaccaactgccgaattattcctttgtccttaaaatgtgtagttccaaaactcagattgacaagtcttatattgttcatcagacaccagtcaaacgctgatttcagatcatccacatttccttttcctgtattatcaagcagtttataactgtataattctgcgtcggcacaattaagccctatgatcatggcacaatttgtcccatgcagaaacaaatcctcctcatcactgatatttcctttgttctgctgaattatatcgggcagcccacataatgcaagtattttttcatctgcaccattatccaatactgcaatctttaatttattcataggtatttatctcagttctaatcttttttaatttttcctgtattgcatcaaccatattgcataaataatcaaatctttcatctatgacatttcgttcttcaaattttattccaaaataactctcaacagcaaaataaagctgtaataaatctcttggtaacattccatttctcggatcaagcaaactgatttttttatccactgtgatatggattgtattttcaacatattcttcaatccatttttctattgcttccttttccatcactttctcctttaatactgttcatattttccatataataataactttttttctgcctgtttgaataaaatatcattatttaagtcgctggttgtataaaccttatactctgttttaggaagttccatccgcgacaaatatacataactcaatttttctgaccagattgaattagacaacggacaaaattgtgaaacaaaataagcatctatatttacattatatttatactttgccatttttgaaatttcagaataaaattcatcattatatccattattagccatcagcgatgttatgacaaaatctggttgaaccgcattaaatatttcatacgcatacaatccaaagctaaaacgatgcttattatttaatggaagtaatgagtctggaattcctaacagaataacatctggcttttcctgcatagaaacatccttcataactctgttaaacgcatacactttatcaacatctgaatattgtgtattaaataaaaagtctggcaatggatgtaaaccaaacagtccacttatttttttcgtccctatctgacttactttatagcccttgtcaataaatctacttctaagatacagttgtaaatcaaatttttgcacattctgaccaattcccattactgcaacaaccggtatatcaatccctattatctctgaatcatagttccattttttttcaggtatttctattgtttcataattgcattgcaacaatttcacattgtacctcttgcaaattttttcaatctgatcaagatattcttcttctacgcatatgatattttttccattagaacatacaaattccactattttatataactcattttcatctggaactttgtcaataatacaaaaagtgtcaaaatcatcaaaactaatttttccgtccaccaaatcagtaaaagtacagtaatcatcattatcattttgatgacttatcggtaaaatattaccataacacataaaatagataatattgtatctaaataattttttatactttttaatatagctatgttcaatcgaatatggataaataacaacattcatctcttacgcttctccttcctcaaatttacagccaaaattttttaggacaatataattttttatgtattcttctgcatttttcctcgattgtttgcaccatttcaaacgattggctgcttctatctttccattctcgccagcttttgccacacattgagaacacattttgtagcaccaacattccctgcattctttttccgttatcttcgccacattcaaaatttttttggcattttctaaatcaaatccattttttagatcacctatacataattcacttgattcctcatctactctttcacatgggaaaaattttccatccactgtaacaaagaaacgctgtatacctggcagacattgtcctcccggactgattttcccctgatatgtttgcaatccgacaaatctatctttaacaatttgcttcaacgatgctacttcgctactatataaagtaggcttataattcgaaaaaatttccttattgcaagcatataaatatgttttaaatatttcataatatgatatagctattagttcaggattaatcggctcttcatccttcttgctaatcggatttatataatttgaagccacatttattcccttaacagtttcataattcaaaaaaaattcacttgaacaagccacattttgctttaaatctatcacagcattaaatcctatattttttataaatcccggtaattctttccttatcaattccaaattctgcattaccgcatcaaatgtccctttattgctgttagcgaatatacgattactgtcatgtgttgcttttggtccgtctaaacttattgtaacattaaattttttctcataaagatactttgccgtttcgatatttaataaagtggcatttgtcgtcatattaaaaagaagttttttcccactaaacaccccctctgcataatctaccacttctcttatcaatggaacttccagcaatggctctccaccataaaatccaatggatatttctttgctattttctgaatgttttaccaaaaaatcaatagcctgcttagcaacttcgactgacattctcttattgttatgtactctgtttatataacttcctgaataaacacaatattgacatctcaagttgcagttttgtgtaacctgcaaaataatggtatttaaattattttcatataaactttccaataaagatatttccccatgttcaacgactattttttcatcaaccggtttcaggcagcctgattcttttaaatattcaatttcttcttttaattcatcaccaacttcgatttctccattactattcaaaatagccataagaaacctacacatttcttttgtaatagaaaatatagcgtttgttccagcatcatacatataatacctgttgtatagttctaaaatatgtatattaggttttgatttagtcatatatacttctccttgcgtaaatagtgcagcagggctttactgaacacagtaaagccctaccttgttgaaataattcatgttctaagcaagtaacaataaagaacctttgcttttaacttgcgtagttgaagtctgagtattagatgctacctgttttccatttgcacttccaatactctggcagttgttacaagtacaagcacaccagcaattgcatgaacaagcatatgccataaatgtacccgtttccattgcattcttctttccaagcttcattatgtttccctccttccttgcttttttatatagaaatgctaattgcatcactatatcttttgatcaaaactatatattcttagttcattatctgaatcggacactaaatcttttgaacttcttttcttttcctctgctctcttttcctctttccttttctcgagtctttcttcaagttctttccttgctttttctgttcccggatcaacctcatctgttaccagtacttcttctgttatgctatcatatccatttattgtatccgttacactcagtaccttacagccacgagcactttgagcggctttcaatttttcgatactttccggtattaaagatagattatactccaaccattgttttgtcttttcatctcccatagcctttgacaaaagagaactgtttatatttacggaataatccctgcttcgtaaacaatcgtatttttgtgttaaatagttcttatattcatgggcattcttatatgtcctgcccgttttgtttccagcattttgtgtattgccataactattcgtatatgacgcataagttcctattcctgtaactgccatattaacatatctcctttcattattcggagtccttccaactatgccacctgttggatttctctcagaatcaatataatattgatcacacgctagcttcaaatatactttgactaatacctttctgcttaacaggtataccatcatcaatatcaatgttatagtgcccactacttgcactggaaaccgttgaaatataccaattaccattacttgcaggcataatcatatgatgcacattcccctgactaggagactgtgttccagaagatgaaatacctgtaactatagctttgttagcaattttcgtatcattagtcaaatttaccaatataacagatgaatctacacctgacatactaataattgagacatttactgatgatgtctttattctggcaagttttttccctcgaattctttcttatctcaatccatgctatgcagatttatcaccttgaatattgatttccttttagaccacctgcatctatactttaaaatctaatccaccaagagtatcatccatctgatctaaaatacttgtatcaaatgcatctcccggcttccatccagaattatttttctttaccagtgtctccattcttgaagcataatctccagccattctgctcaatgtccacgaagcggaatttcgctgttcagaaggaatcgtattcaaatactgtttgattacatcatgtctcttgctttcttctggtatatatgcaccattgctactgataaaatcctgctttacaaccttttctaaatccgacttcaccttatccgatacagacactatctttttccaatccttaccattgatacaacggtctgcctgttcctttgataaaaaaggtacaccatctttattatagtaataattgttatttctatattgacacccagaatctacggtcgtaatcccagtctgcttgtgtgaagaatttttctgaaagaagaatttgtttattagcaaactttgcgaaaataaatttttattgttaatatttacattcatatttcactctctcctataatacaaaattgtagccacattacatttttaatatgtataatatacttttattgtttcagtggatgttgaaactgttccttttgtaacaatccatattttccacttgcctgacggatcaaaaccattaaaatcattaattgttattgttccactcttacttactgttgtataattaacatttccattgccatcttctacatataaataaaacgaatcacttcctgaactaaccctactatacacctctatttttaaaatctgaggatttgatccacttacagaccctgatgaaacagttgaaatatttgatactgtcccatatacagaatttaattttgttgttgtcttagtccaataatttgtagccctcactgatacagtagaatttatagttattgtttcttctgccggtgcaacttctgctgccgatacatgagttacaagaagagctgtgcataatacgattccactcaaaaaataagatataattttcttcatcgtaaatacctcccataataatatttcaaaataatatggctacaatttctttcatcaatttttaatcaccagtttacaactttataaatggtagacttgttgatgaatcaaccgatttaaagcctttttcacagcatttgtttttatgtgtgtttcgacatttttgacgaaagtggcaaaaaatatctgtctgcgaataccctggcttaattcaaaacgaaattcctgtacactctttgtgcgatattcagaaaaagttttatcctgatacggcaaaagtttcatggcacaatagctgatattgatcagattgaccagcatttcaatccctttgcagctccgcaccatatagctgcaaaaagaccagaatgttttctgctcatagtcgcttgtctcaatattccagcgaaatgagtacaaaaacagtgggatatatttcatccagtcactgccggtctgattcaatggtgctttttcctgccatgcacagaaaatctgcagttcttctggaaaaatcgtactgaaaacaggcgttttttaccatgctctttttctgtggctgtgacataagccagaacttcctgattgccaaagatcctggtaaagacacggcggacaccggtatagtaatcaccgattttttcaccggaaaaggtaaagtcagtctcaacagaaagccgttttccatgtttagccggacgccccctgcggccggtatgtgcaggagcaaggtcatacataacagaatcaatccttgcattaccaataagatccaggttcggatattcattgacaatacagaccagattttgtttcgtataccagctgtcacagagaataatgacatgttccctgctttgaaattcaggcatgactttacggatcatggtggcagcaagttccagtttggattcttttttcttccacatacggcaggcattattaacatttgtgtttgtcataatcatatcgaatggcttgagtatttaatttccatcaatgtaaacttatcttcttccaaagcattaatctttagcctttaaattttaacactcatcaataactgcgataactgattttgattatgatgaatcattgtatatttttccttaaatgaggtaattgcaccatacattttctcagttaaattttctgggatttcgtcctttcccctggttttttgctcctcaatgtaagccgatgccaaagttgaccttgtggtaatttttgaaattttattcatttcttcaccaataattccacgggcatgctgattggttgtctccattgtcacaaagtcatccactgtttttttatatgcagcatctaaattgcttaactcttcatcctttgtaagcttacgaggtccattttcatcagctacatatatttctctggttccattttcatagcccttcacaatttcatcatataattctgcgtatgctttaacataattatttgccttgtcagtaatatttaaggcactttttcctgtatcaacattttgattctgctgtgctgccttcttttgaatttcataactataatcaatatcactgatttttttactcgctaacagttcctttctttgaaccacatcatcatatttttcctgtccactctgctgtatacgattacgataatactccaatccctcattagaaatcgaaagcttcactgattgccccactgtatgtttttcgtttgtctgactatttcctttctgtactttatcagtatttttttccattattgaattcgtattattcatgtaattagatattttcatattgtcacctcaatttccatatttatacaatgtcattgacggataacgtctggtgaatgtcaaataatttgatcctactgcataatcataataataattaaaattttctatatctattaacttacctgttgacggatcaataataactgtcacggctttaaagtcctgccacaaattattctctttatatgcccctgtgcatctgcaatgaacactgtagaagttactgttattttaattgcatacttcatgccttcatatcaaaattatcttgcaatattatgttttcacctacactaccaatcttttcttcactatttaatgcttttctcgcctcactaaatgcctcataatatgtcatttttaatgctgaatgaacctgtgactctgcttttgtttctttttcctgccagcctactccccctgtataggtcaaaacttcttcgccctcttcattgtatacatgaattgccgagcctgtccctgttccctgatattttgcctcataaggtattccaaacagcatacagagccattttttgtctgcttcctcaacttctttcattgctgacatattacctgaattcattgattgactaaactttccaattaaagcagctctattcggggctactttgcttacttccgtctttctcaaattcataaatgcatttcccatatatacattgtcctgtgcatctttttttgccagatcaacaatcttctcttttaaagaatccgttaatttccatttgttttttttagaagatttagaaacatttttattcgatgtgttccacacttttgctgtgctataattatttgatatttccatttaattgaatcacctctctgttctgtcatttatgtaatcatacaattccttatatgacagataacctgataagttgttcgaattatattgtaactgcataaattctttaatcatgctcatatagtctttcttttcatttatgctgtttctgctattttatcttccatttgcagcaacattcggatcattgttcgcctcaaaggaatattgtcaagtgtgtatgtaagagtttccagttaataaacctatacttatatttttacttttagtttttctaatttttccagaaaagcaacataaaactctctttctttcatacaagctcgctgaacttcgatacttttcggaacatattcccgtgggtgatctaaatcgtaaagagcctgactcgttgcctgaattgcagactctgttgtatttcccaaaatgtcgatgttatccacatctccctctccgttaagctgtttattcagcctttgtaccatcatctgcgatatatggctcaacattccatttttctttattcccatgccgtttgcattaactaccttagcagcttccatccatgcatcttttacatcctgcggagcattcggaccaatcatatcaaatgctttttcgttaaaatccgtatcttccatatatggatttatactctcattttcctgttcagcacgttctgtactaaattgaggaatatcattctgtctgcgtctgttttcatatggcacaccattcatagaatagttggaactaatctgcatatatcaatactcctttttatttgaattgcattattatcattaggctttcgcttcaaaaactggtcttttctccagataatccggtagttcttttaattcagaattcataccattctttacggcattatattccttccagtaaatggaatagaattcatctttttttgtaagttctaccggagtcatttcgtatccccagccggcaccggtatttaacaatacattcacgccctgactctgaatttgaacaccataaccacctgatgttaaaatagtgaattttaatgttccgcctcctgccagtgcaatctgcttgtctgcaagattctgattttttccctctgcctgttccaaaaaatccagtaaggttaattctccgatccctttacattttggattggcattttgatttgctggtttactgtgtttacatctgttactgtcttcatagctagtctccaaaccctttttcaacattaaacgccaaacatatgctgcaatttgtccagcatattatttactctgccttcaacagcttctggctgattccttaattcatacctgcttccatagtaatcatttaaacggtctttcatctcattacaaaataatttttgatctgttttaccatttaaaaactgattgcagataccacttatctctttcttctcatttgtataaaaagctgtctcatctgagattatttctgacttgtacttataagattctgttttgcttccaattccaacaacaatgtaatctggtgtcattttctccatgatagaattacgtgccgaatcattaaaatgaacatattcgtcaatcatgtctgaaaaacctgcttgtaattgctctggaacatacatttcatttacttttcttagccccgcttcacttgcacttaacaaaaatacagattcataggaagttcctctatatccctcctgagcattcaaaaaatctacatctgctgtcattgcattaatcttctcttttaaatctttcatttcatcttctgtcaaatattcagaagcattttcgtccagccatttttcaaaaacctctgactgattttccgaacagccttcaaacgcactttgttctccagaaatggaagttgctttcaaatctaatttgaataaattttcacatttatactctgctggtatctctcttatttctccattaatagatgaaaaatgcattgtatgaaaatccgataccttattacgagcagtctcaactaactttcttgccgaatcactgatttgtatatcatcttcctgaaccaaagcatgagaactattttcttttttctcaatatttctgcttgtcatatcaggattattaatatacatattactctgaatcttcatagcagcctcctaatccactggatcataattgtaatttgcctgtactccacttacccttgtccaatgaagaaccactccattgtcatataatgggtttggtgtcattacatcaacaacttttcctgtatcagaatcaataattactgttgcacaattacttgttagaccatcatagttacttgaaaaactattaactctccaattagtattaaacaatcctacaacaagggcatttttataggaattccaaccgctgaaaggcgcacttacattgataaatgttggaacttcctgcattacctgcatagcttctgattgaaataagacaacattttgatcctttgttttatataaattaaagtaaatatttccattggacttaacagttctttcataagtaaaatctatcggatttccatttacataaaaatttgttcttgaaccgtcaaactgaaaaattgctgccttatctggtgtataccacatatatttcgcattttcatcatctgccaatttgtacttttgaaattttattccataatatttgtcatcgctataattcatagaactagccataacaatgaaataatatgtacctgtatttaatctgtatgtgccattattgattgtataataattctttccatcatatactaagaccttataatcacaacctgttggctggtcaaaagtatattccagaatatcatttttgctaataactactttgtaataatcataatcaaatggactatcaatcgtagccgtcatacgactatttctcacataagaactcgccaagtctgttgtatcattgatttctttgccgtcattaactcctgcatatgtatacattaaaaagctaccatttcctgtcgctgcttctattccaataaaatatataccttcatcaagctttaacattgataactcttgcgttccggctcctactattgcacttccacccacaagttctaatgttccatctgtttcatttaatttatatacatataaatcaaaatccgctgtatcatccattaccattgccgctgtaaatttagtcgcttttgcaacgctaaatgcataccaacgctgttctaattctgttgcaaccgtatcataaacctgtgttcctaatgatattgcttttgcatcattaggattatcatttactgtcttattatcttcagtattatccgccatatctaccaaatttacagaatagtcctctgtacaaatcttttccatatcattaatatccgaaggcaaataatctgcaacttctaaatcctcattatcctttatcgcagaaaaatcaataacaccctcctgcgatgctgcggtttcacctaatttttctgttaccactgcattttcctgagcatgaactacaacaggaccacctgcattataccctaacgataatgccataatcatagcaatagttcctgccatcttctttctaattttcataaaatttccacctttcctcattaagataaatattataatcaaagcatacgatatttttatttgcttccgattctttaaaaatttctacttcaagttaaataatttttcgttttccacttcaatagcgatagattttaaagtaaaaaaattgggattatttatcttttcagcacctataattacaccatatcttttttctatttccaagaataagcacagaatatctcttgccttagtccctatcgcagatgaaaataaagatatattttcatttatattgctaaaatctctgccagttatttctgacataatccgtcttatttcatcaaccataatttgctctttatattgcatcaaaatcaccatatcctatcaatgttgaaaataaattttctttacacgcttccacactttctttattgtacaaagaatagcagccacatattcgggcttcttcatccactacattcactggaagcgtcatatatacaagcctatctaatgagtctgtcgcctcccagttgatatagaaatttgataaaaatacactgtccacatcataatccagcctatatttcaatgcctttaccatcgtttctacataattattgttgtaatccacaaatccggtattcaatattacataatctggttttactgcatttgcaaccatataattcataattccaaaatcatcaaataatttattgctaattggtactacaccaccaggcaccccaacaatcacaatatctgcgtcttcagaatttgcaatataattcacatagtgattaaatctcacaattttttctgcagcattaagggttttattcataaaatcaggaaaactgtgaaatccccaaagctcacaataagatttgctgcctatttgtgatactttatatcctccacttaaaaacatttctctgactctaagctgaatatcaaattttccggtatttgcacctgtaccaacaatcataactaatggtttatctatgtcccgaatcttaggtattccatctgaatataaatcttcattaaatgtcattttatcattctcttgagactcatatctaatatctaaaaactgctttcctgcactctttattatctccgtgtacatatttatctgattgtgttccaacggaatattggtatctgcaacaatcactatttctacttccgcaagtgctttctgaaaatcatctgttaccataacgcctgtacttacaccaagctttgctcctgcatctgctccacaatacccccagctctttaacgaaactactttgacaatttcatattcattgattgtatctctatgaataaccatatgaagaagagatgtatcatatggaaatagcattgctttcttttttttcatctcgacctcctacaaaatagttatattttcatcaaatccattgatttcctgcaatatgcagtaatctataaaatcattctcaaccgatgctttcgcctttgcacaatgatccagtttttgtgccatgttgttagcttgtccttgttttaaatgaactgcacatacaaaacaatattttgcacaccaacaatttttacactgtacttctgtcattttccctatatttagtaatttgtctacttgtgacttatcaaaaccactttcaacatttccaattatcatatccttcgattcttcgcacactttctcacaaggataataattacccagtacatctacaaacaatttatgtacacctggaatacatggtccactcggatgagagtattcttcatgtaaccctgttattttcctatctccatatgtggtttttatctgccaaaaatatgtttccacaatatttgatacatcaataccctttacttttccatatttagaatacatcattttgaatacttcatattcatactgctcaaaataagaatctccaggaagaaatttatcatcttccttgattccctctcttgaaatagaattaaacaatacacgatattcccttaaagcctcttctttaatgaaaaaatcattgatacacttcaaatctgcctctggatcaatcacacaattaaactgtatattttcttttttatcatggtatttccgatataccatttttatattctccatgactatatcaaaagagcctgtatcgtcaactctatgtcgatttttattatgatattgtctcggtccatccaaactaattgttaatacaaaattatttttcatcaagaagtctaatttctcttccgtaagcaatgttgcatttgttgttacaaaatatctgattttctttccataatattcattgttgcaatattccacaattcttcttatcatttcaaactcaatcaagggttctccaccataaaatcctatctgtgcatcaggaatatcaaaggaatgtaaaaaataaaaatctatcgcctttttagctatttcaaaagacatttttctgttattatgctgtctgttataaaaaccacctgaatatggacaatattcacactttaagttacattgttgcgtaacttgcaacgtcaatgactggactgatccttctaaataattttctagtaaccttgaagccggatgttcaattttacaccaatgatgacttgataaaaaaccttgttctgttaacctatttaatatctcgttcacatcagcatcacattctgaaatgtttgctgtccctttttccaaatgctgtaaatgtacatacacactctctggtattctgacaatggcatttgtattaaaatcataaaaatagcaacaattatatgttctaaaacaatgaataaatggtttttccttcataataattttcctcttataaagtatggcatccgctaattgctagatgccataccccttttttcattcctatctgcttttatttattttgccttacgttcagaatcgttatatttagcagtgtaagaatttgtacccgatgggcacggacagttagtgcagacacaaaaagcatatgcctgtaaagatttcttatctaactttactttttttccaagttttctcataaaattcacctcctagtataataatggtgtagtcaatcaagactacttggttaataagtttctgtaaatcagataacaaaagaagggattcttccttcatcagatgttatccataataattatcatgtctgacggttcctgatagacaccagataaaacataaggtattatctcttaggataggacaaagaatgttcacctccttgggaagtcacttctgtgactgatacctgcaataaagtcaattagtccattcgacagggttttatgttttagctggttgggagcctgaaggccatacccgaataacacgctaggttgtgtacctgccagattggaaatggattcctatcagaaaggggctattgctcatgtcaaacaaagttatttttaatcttgatgaactattcatctctgttggtattgatgtcggtgctgatttctcatggatgtctatagcacttccaaaccaacaattcgtaggaaaaccttacaaaatcctacataacagtattgattcccttacaaccgctgtttctaaaataaaagaagcagaagagttgtattctttggaaagtcgcattttcctcgaatccacgggaatttatcattacccactcttctgctatcttcgtgataagggttttaactgctcggttattaatcctatcatcactaagaatagcacaaatatcaacatacgaaaagtacataatgatcgttttgattctaaaaaagctgctttggttggtttgaaacctgatttaaaggtttcacttatgccttcagatcttgctctaaactgccgtaacctatgccgtgaatactacgatttaatggataatcgcagtgcctatgtgaataagcttcagggtgaattacgcatggcgtttccacagtatcttggcatcttttccaaggttactatcaacacttctcttacattattggagacttatacctctccatcagcttttcttaaagcagacaagcaagagattattgatatcatcaaatccacagctcgatttgggcttacatatgctcaaaataagtataatgccataattcaggcggcaactgatgcaaatcagtttggttacatcatagacagcaacatcaagcgtattcgcctttatatcagattcatacgtaaatatgatgaagaaatcaacagcattcttgaatcactccacgagcttgttgatgctaatgaagattctgactttgtcaagcagattcatttgattgaaactttcaaaggtgctggtttcttgtctgctgtatccattatgggtgagatcggtgacttttcagcattttcaaagcccaaacaacttttcgcttattttggtcttgatccagcagtaaagcaatccggtaaatttgaaggcaccaaggttcaaatgtctaagcgtggttctgccatagctagacgtgttattcacacgttaaccttacaaagcatcagtatctcccgtaatagagaagctaaaaatccagttcttcgtgagtactacctcaaaaaatgtgactcaaaaccaaagctcgtagcaatgggagctgtttcacataaggtatgcaatatgatatttgcaatactcagagataacaaaccattcaaaatcattgctcctcaggagcatatcaaacaatacaattctgctaaatgcgacatagctgcataaaatactataaacccaatgaatcaatatctttcaaaaaacgatattttcaccaaggggaaagtccgcccttttttagtcagaaaataaaatagattttttctcatttaactattgacatttattagctggactttttatacttgtcatcttggaataaacaattaagttcctatagcatctatggctacagatataatagtaaaacacgccagttaactatctttcacttttcttctggataatcggacgtttcggctgatgaaatattcccatgcatgcaggtgggaatctatctattccatatacagcttcatttctcatgacatgttctacaaccttcaacactttcttattaaccttcttcattctttcacctcctgtttaaaaatttttgctatacacagcaaagctgcacataatataacagctattgccatataactaacgtaaaccatatctgcatctaacagaacacagccaagtattatgcacccctcaagtaaaacaatagtcctcgcagattttttcgattccatcaattcatctgatgtcatgtgcatattaggatgattcgctgtaccaatcaatcctatccctgttatagcaagtagtactattgcaaataaccattgtggatgttctgacaatttttcacttataatcacgataactaaataagaaacaatggatgctaaataacatctataaaacttgtccagatgatatccgccagttctctttcttaattctaaaaaaaacacaagaaaaaatatagttgggagcagcttgtgaaacatcaaactgattacgataatactgccaacagtaataaatttctctatccaacagataaaaacataaacatatcttgcttccatctctttgtcaattaaccttgcttcagtcatctgaccaattaaatcatcagctattttttcaatcatagttatgcctcctgccaaattaagtataactttatctgtttacaaaacaatatccattgcagaaagtgacctttttttgcagaaaatgacaaaaaaaagtgatttgcttgcagcaaatcactttttgggtattcaaagttttttagggtctttactttttagggtctttcgttcgggttcttcagtagggtctttcagtagggtctggttttagggtttatcgtgagggtttgaacctatatttataataaaaacagggtatgttagctcgtattacacaagctaatctaccctgtttcttttttgtcctgcctcatttatgattattttgcggaaataaaatttcaaaggaggacaaatgaataatatcacagatttactagaccttgaagactctgatataaagatttcagacattattattgaaggtcaaaccaaaactcttattatcgaaactccacctgttgccagctattgtccaatctgtgggtttcgcatgcactctcgtggtgtaaagaaaaggactattaaccatcccattcttcaggatggttattccttgattctgctactcaaacagcgccgctggcgttgttccaatccagactgtctgtatgaagttaatgaatccttccgctttgtcaacaagggacgtagaactacaaatgcaactgacatgctcattgtagaggcatatcgaaatcttttagaaacatccgcatctatcgctaaaagattccatatgtctgacacatatgtgcacgagatctttgaccgttatgtcaagctggacaggcttcctcttacagatgccatttccattgatgaagttcacctagatatggatgatgactgtaaatacgcattggtcatccaggatttccataccggtgaccccattgacttgcttcgcagccgaagaacttccgtaacggaaccgtactttgtctcaatccctgcaacagaacggaatcaggtaaaataccttatttccgacatgtacaatccttacattgcctatgtagaaaagtacttccccaacgcagtccctgttgttgattcctttcatgtaattcaatggattacacgttctattgacaactacatacggctgcttctaaaaaaatacaggcaacgcgaccgtgaatatcaggacaagctttcctatgagcagcaacgacctgtttcacttccgccatcagacgaagtataccttctgcaaaaatacagatggttaattctgtccaatcagtccaacatccggtaccacagtgaccctcgcatggattctcactttcatgtattaatgaacacctatgattacgaagatgctctctttcgaattgatccaaacttgaaagattttcgagacttaaaagagatgtacgtacaatttaattcacgaaacggcggaaatccactccttgcacggaatgaattaaaagaattgattcagacatacaaaagctcccggtttgaaatatttcgtgactttgcatctttattgaaaaaatttgaagaccctattgttaattcatttattatggtcgaaaaaatcgggaacggcaaaatttatgatgcacgtttatctaatggtcccatcgaatccattaaccgcaaagtaaaagatttaaagcgactgggcagaggcttccgcaactttgagcactttcgcaacagatttctttttgcaactagacaaacaccggtgcttaatggaatcactgattataaccctgtaacttattatgaagaaaatgatttttaggaggaaaccacatggaaaactactgtgcatttagtaaaaaccacacttgccttaaatggcttgactacataataacacgtcaagaactagaggaagcagactctctctgtcacggaaactggatagagattcaacacaagaaccaatacattcagaccctacaggagattctggacagcaatcacatctcataccccgatgaaatatagtttaatttaataaaaggtctggctacccagccagaccctcataaaagaccctcacgaaagaccctaaaaccagaccctatcgaagaaccctaaaaaactatgctttttttaaggccagaccctatcgacaaaccctaaaatagattggcaaaccctaaagaactttgattatcccaaaaattactccttaacggctatgtaaaatcattcaatattcaattattaaaagcaacatgaaactgaaatttcacgcagactattcctataccgtaatgtctattctgaccgatgatttcttctcaccaaaatgctttatttcgatatccttcatttcctctataacatctttttcaatttggtgaacatcacttaattgtaaatctcgcttcgaatcatttactatttttgctgcctcatctactgaaacagttgtatctgatgttaactgttcagacatttcagtatcgtttgaatcctctgcaacctgccccttttctatagatgtctctacaatttcctcttctgttggcaaatccctatattctgtactttttacaaatcttgtgaatgactctacagctctaaaagtatttcccatgatacgttgagcttccttaagcttttcactctttggaatatttggattattcacgatactttttagttctgccaaatttccattcatctcatttacttgaagcctttgagcctcttcttttgtcttacatctctccaacctacgctcataagcttcttgttccattcttgccgctttatattccatataggctttagggtctttctgacgaatagcatcttcttctgaagctgttaattcttgaccgcttgcaatcttgttataaatctgactatatgcagaactttctttgtctcgctcaagttgctctcggaaatgctgaatcatgctttcttcctgacttgttacagtcataccctcttgcttctttacaacatccccggtagccttcttttgctcccaatcatttactaactgcatctgattcacagcgtttcgtattgtacctgcaatcatagcacacctccaattcccggttaatgctacgattaaatagtgatatcaaacttcataccctgtgttgccttttcttctgttatcttactccaatccagttcagaaatcttttcaagtaattcttcttttgaatttgcctgaattgtagtccgcttaacagttacatccttcttttcctgctttttctcctctgcacgtttttcctttaattcttcaagccgttctttctgcttttctgtaatcttctccaaatcagcaaaaagtgtcatctttccatcatcatcaaaggacatagttaacttatttaatacagttccactattgtctgtcgttccccaagcacgttcaaacccaaactgttcattgattttatctgacatctcaactgcagtttttaccgtagacaatttttcccgtgcatatttctcatcggatgccattctttcaagttcagcacttgaaaaaacaactgtaaattccttatcgctttggtctactaatcctctgaaatcatcgcctttatcagcaataataaaatcgaaatccgcattatccttacgcaatgtttccagatatttctgtgccttagaagataacttatcttcgctggattttattttctgtgcattgggctgcacatcttttgctttctctgtgttattttgcttactaacagtattgctcttataataatctgttacctgtgttaaattagctgctctaatcatggtatcatcctccttgaaaattgatacagaaatccgtttctatatctgtaatatcggcactttatatccaaaagttaatagtgcgtaaaattcaaattttcttttccctaataattacaaatattccttggaaattgcttccacaccatacatttccataaatgcatccaggtccgctgcatccccaatcaacatattctcgtcaaagtgtacgataagcatatcttaaaatccagccacatgttctccggtacaaatgatacattttagaactgcttccttatttatttttcatatcgaatcttatatgctttcttcttaaaaatagggaatatctaatttattatcatcaaggtcggacattcatccgacctcttgattatactatagattctataaaaattcatctgttatcactgcagcattgcttctccaaaaatgaatttctaaattccaccgcccaatagggtgatggaatttactctcgcacagtagatatttactctttcatacaatcatgttatggttatgactccttctgacagcagtagaaggagaatcattatgagtaaatatataccaggaaaccagaaacaccttactttaaatgatcgtatctatattgaaaatgaactggcaaaagggactccctttaaagacattgcagcatttctatgtaaagatccaacaactatatctaaagaagtccgtgctcatcggctttcagattggtatcacaaaggtactttttataacgcaaagaacttttgcattcatcgttaccattgtcaaaagaccaatgcctgtggaaaaatccttctctgtggcattaaatgtgcctcatgtcctacatgtaatcaaacctgcaaggactttgaaaaagaacgatgtaaacgattggacaaagcgccatatgtttgcaatggctgcacgaaaaagataaatcactgcacgattgcacataaatactattacaacggccgtgctgctgacagaaaatatcgtgaactgctgatatcttctcgttctggaataaatatgaccaagcaccagctccatcagaaagaccagatcatatctccattaattgagcaggggcaatccccttatcaaatccttacaaatcacccggaactggatatgtctgtccgttctatgtacacatacattgacaaaggactcttcacagcaagaaatattgatttgaaaagacaggcaaaattcaaaccacgaaagtgtcataaaacacaaatcactgatcgttctgtttttacacacagaacctactctgacttttgttcattagacctgtcgtcttttgtggaaatggatacagtccattcctcaagagaatcaaacaagactctcctgacactgttttttacgaaagaaaagctatttcttgcctttttacttaaccgatgtaccaaaggtgctgtaagacttacctttgaccgtttagagaagcgcctgggcacatatgaatttatatccgtttttgaaaatatattgactgatagaggttccgaattcggagatccggtaagccttgagacaggcattcatggaatccagagaagcagcatctactattgtgatccaatgcgcagcggacaaaaaggcgctatagaacaagcacacacaatgcttcgtatggttttaccgaaaggaacttcttttgaattcttaacacaatgggatgtgaatctcatcgtaaaccacatcaactccactccgcgagaaatcctcagtggaaggacaccatatgaagttgcattagaaacgcttggtgaagatatcttaaaagcatttcagcttaagccgattgaaccggataaggttaatctgacgcctaagctgatacgctttaaccattaataaaactaatcgaaatctgctgtcagactggatgtaaatttttcacatttttaagatgcggctggtggaatttagtctagcacaccgaattccagtagcctatttagcatgtctagaaatcgagaaaatttcgataagtaacattaattatagcagaaaacgagagatttagtccaaaaatttcttgttaaaccagcaaaatttaaatcacgatggaatttactcttgcactggaatttactttttcaagtcagccagcattgcttcttttttcttctgttccgcaatcttctcatgaatgttggtattatacagcctgtacaaatccgtatccttgctgatctgattatcaaagggaattactaccgaaccacacttaataagtcccattccagaggcggtattagttacgaaccgaagctgtgcctctgataccccgataacctccgccatctttgaactgtctgtatttgcctgcttcaagagtgccacaaactcagagtttgcaagcattgtggttgctgtgtaattctgcaacagatcgacaacattctgcgtgataccggtacaaagacctccctgctttcttaccttcttccagagctgctgcagatattttgcagaatactccgaattaagcaggacatggaactcatcaatatagagccatgttgccttgcctcgcttaccattctcaacaatcctgttctgaatggactccatcataacaagcattgtgataggactaagctctgtacctaagtccctgatgccatagactgtaaatctgttatccacatccacatttgtctggtggttgaagatgttaagcgaaccatttacaaaaagttccaaagacaatgcaatgtcttttgcctcgtcctccggctgtgccatgagaatatcgtaaaaatcactcattaccgggatatacttctctttgctccttgcaatgtcgatatacagttttctcacacagcggtcgatgattgacttctgtcttgaatttaagctgtcaccgatgcactgctcacaaagaccaagcatgaactcgcccttttctcttaccattcccttggaatcattcggatcaaggctccatacatccatctccagcggattcacatagttatccgtgtaggtggacatatttaccactgttccaccataagtctcagcaatatcaaagtattcgttcattggatctataacgattatttcatcatctcccgacaagaatacgctgcccatttccatcttgcagaagaaggatttaccggaacccggcacaccaaatacaaagccatttccattgatgagcttctttctgttaccgatattcacattcttgctgatctggttgatgccataatagtttcctgtgctgtcatttaattcctgcacattaaatggcataagcaccgcaagtgactgggtaagaagtgtacgcattgtctccacctgtcttacaccaatcggaagtgctgtgttgagtgcctccctctgctttaagtagtgtgtgtcaatcgtgcagctgttacgctttccgatagtctctactgtctcacatacactctcaagctccttcttgctttctgccataagaataatggttactcccacaaagaaaaggcactggtcattctcacggacatcatccatgatttcctcaatctcctttttctccgtccttttggcatatgagatttccgtagaaaaatcgttattcttattacggactctctgctgcttaatgatatccgactcaataccaaggtatttcttctgaagcacctttgttgtcagatccttgggaacaggcaccacatcaatgctcgtgatggaatgaaccggaagggaagtaatctcattgatgaatctgtctgacaaactgctcggatactttttgataaaaagtgccttgcagaatttactctcatcctcaaaatggtctgggaaatatttcaccatcccattgcacagatcatttctaaaatctgccccgaccttctttgcctttttgatatcaaaatcaaagctgccctcatctccaagatgataatagtcatagagcactttcagtctctcattgccattaagcgggacaatctctgcgccaagctcaatgaaagccttgtgtatcgttgcctcaagggttgcgaactgtgcctttgcctcctcgaagttctttctctcaatcgtgattgtcaggtatctctcctgctcaatcccctgtctgccctcaataatcttctcctcaatgatgtcattgtagattcttctgtaattattgaagccatcatttttctcagcaatcagaaccttgtcacggagttcatccatgtttttgttcttattgttgattgtaatcttataattacagtccagcgaatttaagaacttacagtatctctcgaaaataccgatctgctcatcctcggttgctgtcgtgtaattgatgtcctgaaagcggtagcatttggaatacttatttttgcttacttcaaaaatgccgttttcagccaccgccataatctctatggtttcctgaatggatttaggtgtcttatacaaaggctcactcgccttctttaataacttaaatccgtctgtaaataaacccatgtctctaacctcgctttcttataatgaaagcccgccgggaacttcaccctgcgggctgtgttcccgaccttgcggtcagatactattcgtttctaatgcattgccttatatgctgcaatgcctgttactgtcgccacaatgactgcgacaagtccaagcagcatgtttctcgtctttttcttcatcgcttcaaactcctcctgcttctttacagccgaatcagctgttacagtctccggttcagcctttctgcctttcttctttacctgctcattctgctctgcttctaactgctttattgcaggctctccctctgttgatacataggtaagtgccctgtttccaaacataaaatgcagtttctttcccatatactcgtagaaattcatcccattaaaggaatagaaaccgccaagagcaatcggcgccacacagggaattgccacataagcagaacccgtaagaccgatatacttgtaaagaagaaggacgataccgccaccgactattacgcttgcaatggaaaatataagctgccttgctgtaagtcccatcgcaaccgattcctgatagcggtcaatatccttgtttacttcgattaccattgtctttcctcccttctacagtccaaatgccttgcttgtaagtgtctgtgcacccttcacgcttccgacagtcattgctatcgtaaatgtcatttcacacagatatataagcgtctgtgcccagtcagcataacttcctgtaaatgccggaagccctgcattgataaatgcattacataccacaatcgcaagtgccatcgttactgcctcaaatacacacgaaagaaaatatttgcagtaggtagccattgtatgactgaccattctgtttcctgccatcgtggaacaggcaatcgcaccaagcggcacaataatcagaatcttcaaaaacctgaaatacactgtatagatgataaaaaatccacagataataatgatgattgcaagcaaagctgtaagtatcagcattaccagactttcaccaaatccaagtcctttaatgatgtctgcctgtgtactgtcaatagcaagctgcgtcgttgttccggcagatataagtcccaccagatttcctatggaagtaaaaaatgctttcatgatcgtgacattatttgcaacaaaccattccgcaagtcccagtcggataagcatacggaatatggactcaaacctcatctcatcttttacatctatgctttccgaacagaaaccgataacaaagaacagcacaacaagggatgagccgaccgctacaaagaccggctcaatgccctcaatgaccgcccagggccctccgcccttgaaactgaccggtgactgtccaagcattgcaaagaccagggatatctgattgttccaaaatccaaacaccgcctcaagaagtgcaaggatcttgtctccaagcttaaaaatatccatacttgttattcacctctttccttttactaaaatgggaaatgcatttccccaatcttagaagcctaagaatgtcagaactgttgaaataccagccatcatgacacctgctacaattcctttcagagcggagttcatagtagatgaatcctgctgctgataggcttgtgcgaactccataacattctttgcaagaataatgacaccgacagcaccaatgactgcaatgataagtgtctttaaattctcaagcggctgtgtaactgcggaagttcctgccgcaaagcaggtagtgctcataagcattactcccataagtgccccggataatgccggaatgaatctcttcttaaaatgaatgaatctgctcttcatgcctttctcctccatctgatcgttgtttgctgtaataatctgttcttttctcatgttgtttgtctccttttcgataaaaaaataagccagcagggataatccctaactggctgttaaaagttactctatatgatcaggcatagcctgttgtaatgattgaatcgggcttttcccgatgtgtttagctgtaaccacctccttccaaggcgcaaaaaagcaccttaaccttaattggctaaagtgcttgtattagtttgatattaaattgttgtgagtccgacaaacttataggtttgagcaactcttgttgcagactcattggcaattgtctggatattccaacgctgaaaaagtacagaaaaaatagctaagataaagaaaagcaaaaaatagtaacagaatacacaattagtgattccaacattacttctccgttttcgtttttcattcctttctttatccactgcataccaatgacctcttatactaatttcaacaaattataaataacaataaatgtgatagctgcaaaagctattgttcccaaacaaccagctgtccgctgtgatccttgacttgcttcttccttgcaaacgctcttagaagggttattcgaatcataataaaccgttattgtataagggaactttacagctaccatacctggtgactgaaacgtaattttctttttatatgaaataccattaactttatactcataagtgcatttcattctatcatttttaaagtttgcgtttccagattcatcgtttcctaatataagcttattatctataagcgtagccgttgtataacacccctgcttttttgctttttccataaacttttgattaaaggaacgacctttcagaaaaatctttatataacatacaaccaaaactaatgcaccagctatcaaagcgatagcgcttctaatttcttcgctcatttttatctccttactcaaacataaaatgcaacaactgcacggtgttttctgttgtactcacgaggcaggtttcattactattaaaatacaatgcatctttgtatgtgtagtcaatacacaacttgtgctcgtcgtttaagaattcccacaaattattagctgcatatccgttcgcaaaacttcttgcatttgtgtattgtggttcaataattatcttaccgctgacttcaacaaatccatatttgtaactggcttcattctatcatatttcgatacgaaaatctatgctcaacggtcaaactgaaacttaaaattgctctcaatcaaattctgttttccatatcaacattattaagaggcagcagcactttagtctgtcaccccttgattatccatctgtaaaactgggcggggctgtcaacggcgggcgtagcccgttcaccttgactgttgactgctccggctggatttgctattcccggtttagtatatcagcaatggcttctggcgcatacttgtttacttcatgtccgacccccggaataataatcaattcgctttgtggtagcaatgagttcaatttctttgccgctttcttatttgctctgtccttttcgccgcaaataacggttacagggcaagaaatttcatgtaatttttcgctgaaatccaaacttcgcatagagtgtgccaactctattgcattacttttcgataagcctgtactctgaaatactttgtccggcatacatcgaaacaaaatgttttgtaaatcaataagcagactcggaactttatactgacagccaatcaatatgagtgacgttacatggctgctgtgtcgaattgtataatccagagcgaaaactgcgccaagagaaagaccacagatacgcaacggttcacgttcttctgcaaatcgtgcttcgcaagagtgcataatctcagaatatgaaaaaccactttctgttgttgcaaaaatattgggacaatcaacttccatatcgtgaatgaggctggttactttctcccaatcatgggcgttctgtcccagcccgtgtaaaagaattgttttcatgttttatcagtgttttctcctttcttgcagcactgtaaatagtcaattccaaagcacacaacagcaagtataagtgtaattgtgctgttgaatacatctgatgtaaatgtatagtcatctcgcggaacaaagcaggcaactatgtggttaatacttgacgctgtgggtattacaacaagcattgaaaacccaaatcctcgccacaaatgtttctgacatttactaaaaatcccatacattatccaaattgcagcaagtgctacaagtgaaatgcaagtaccaagtgtaaacacaatcggacgttttaggagcaagccaagaagcaccaaaaggggaattggaataacactggctgtaaatagagttttcaaaataatttttttctttgcaattaagacgggaatacaaagcccccatgcagccacaatcgaaactgctactactaacgaccatgacaagtattccgaagtgaaataatcacaaattagacatacgcaaattgcaattaaagccacagtggacaaaactaccaaagtatgacgctttactcgttctgtaaaatgaatccctttcttcttttgaaagggcaaggcatttggctcaactaattcttccctaatgaggtagtcagcagatacaccaaaaatactgctgagttgagcgataaactctaaatccggggtagattggtctaactcccattttgaaattgtctgccgtgtaactgttactttttcagcaagggcttcttgtgaaagcccctgctgctttcttaatttctgtattttctctccaaatgtcatttactttcctcctgctattttgttttaaaaaaatcatagcaaatgagcaactaaatatctaccaattcaggcaggaatcgccgcaacgaatcgttgcaatgctgattttacggtgcttttctgccattttcttttatttattgattagctcgattgactgcacctatccccaaccgattttactggcggttgtcaggtattattttaccacagagctataaacatttccaccacaggagctaatgcttattccgatatgaactcatcttatccacagtgatctctggatagaaataagtcagaatcgttgctttcggaactcctgcggcaagtgctttcttcacctcttccttctgctccggtgtatacgaccagtgcagcattcgatttgtgatggtatcctcccacttaggcttttccctctctggattccttactggcttagcaccagcacttccactagaagcgttagcactttctgcagcatcagacttctgtgattcatcaacatactcaagctcatttgcctgctccctgtcaatctttgccttctgctctgcttcatcctgcatggagaatcttctgcttaattccgcatcaccaagcatcataaactgctcataggtaagagaatctatatacacattctcgcccttgtccttcagcttttcataatacttaactgccttatctgtcagaatctcaaatggcggaccgataagattatctgctccccttatctgatggacataaggctctcccttgccatctgctgtctggttaaacatcggatgattgaatggtatgaacttattatccatgataggatcaaaaccacggataaagataatgcactttttgttatccagctttctgacctcatcgggtgtaaacagttctcttcctaatacatcatagttccttgaagagcttccctgtctgccctttgtctctccgcttgatttcttatcaatcgtaccttttccaagcagctccgacacatacttgtgcgtgctctgctcgttgccaccaagatagatgaacgtatcgcagttgccgggaattgtctcccaggtatctttgaaaagtgcctttaactgggcaaagttctgaataatgataatacttgaaatctcacggcttcgcatagtacttaacagcgaacagaagtcatccggcaatgcgacattcgcaaattcatctaacatgaatgtcacatggattggtagtctgcctccgcagttaaaatctgcctgatagtacagttcctgaaatatctgcgtataaagcataccgataataaagttataggatttgtcactatccgggattacacaaaacagtgctgtctttgtctcgccatcaccattgactccaatacctatatcggaaagattcagctcatcttttgagagtaatcgcaagacctgcttattctcaagaaatgcaagtcttgagttggcactgatgataatggaacggactgtgtctcctgcacctctcatacatttgttgtactgctttaccgccggatgattggctccaagcggagaactctcctctaaaaacttcatacgcacatccagcttcgatgcttttcccttctctgtaacctctgcctctccaagaagcttcagtactgtctcgaagtttctctttgccggctgtacctccagccacacataataaaagatagcctgtaagaacaatccttccgccttttcccagaacggatcacttggtgttgctccctttggtgtcgtattgctgataaggtttgtaatcagcttgaccacatctgtttcctctctgatataggaaaacggattgtaacagtctgatttatccatctctaacagatttatgactttcacattgtatccgttattctttagcatctgcccacagcttctaaggatttctccctttggatcggtacagataaaggaacagttatgcggcatctgcataagattcggctttacttcataaaatgtctttcctgctccggaaccaccacagataaggatatttccattgagcttgagccttctgaaatccagcgacatcttcacattctggctgagtatccggttgaaattctcatccttatctgcaagtatcttgttgacctgcttgggattttcaaatcttgccgtaccaaattccttaccgggcatatagtttctctgactggtgtaatacatgacaatagccatcgcatagatacctaatgcaatggctactgcttttactgtattggaattgtaatagttggcaaagggaacagcacatacttcattgaatctgtccataaaggcattaaaggctattccctctacccacgcaccatttatcagataaccaagataccctgctaacactgcacccacaagaatgaatatcagtgacggctttttctttgttgtctgcataggctgctacctcgctttctttgtggtaacagttttcttctgtgtggtctttttctgctgcttctgcactttctcgtaacgctccctgacagatgactccaccttgtcatagtgagtataaagctcggttcctttctgggttgtcaccacacgattctgctcatcgtaaagcttataatccttggtggaatcaaggaaggtaagcattgtctttccaccatgaatctccatgatgttttccttacggagccatacatatcttgcctcttctccccatgtgcctggaactctggtcttaacagcatggtcattctcttcgataatcagtttcttgctgatagtcacatctgacaggttcgcattctttgatgctgcaactgccctcattctctcagcaaggtcctgataacctctgacacgattgataaatgcatccttgtccatcatgactgtatgggtgccatcctcattcttactgccaagcacaccgattgtctctagctgtctgataacactttcagcctgctctccattaatactgaaattctccttgacctgatccacactgatagctttcttttccattgcaaacattccgaccttttcgatcagtccatcaatagcggaattaaccctatccccttctatcgtgtggcttttctcgtttccctgctgtttcttcaaaaaatccatcagcttgccaagggatttttcatctccattcttcagataatcgtcaaatgtggcaatcttgccaaacttgagcttctgtatcatcatattcacacgtggaactgcctctgtatgaaagattacctcactcaatccgtctttcctgttacagtccggaagtactgaatagagtattccatacttctttgccatcttttcaacctttttcatatcctgggtgttaaactggagcacctgtaaatctccaccttttaaaaggagctttctcatggatgtctttccaagtgacttttcataatcaagcattccttttaagaaatctattgccttctgcatggcagctattccgccacttcctaccttcatggcaatctcaatgccatcataagcaacacggatgatctgcaccgcttcctgaatctcttctgccattatcgcacctccactttctctctgactgttgttttaagtgtttctgtctctgtagtacggatttcttctgctgatacatcaataccataagcagttaagatatctgccagatgattgattgctttttcctcctcgatccggtacatttcaagtgccacaagcaggttttctacctgctccacccatgcaggcttcatatcatatttagacctgtatgtgaccataatctcgtccgaatcagccttatccgctgaatgtgccaatgcttcaataagagaaatcgtatcttccttgctgccgcttctgaatgcgaactggacaacaaagtttttctcttcctctgtaaactgatgctccacaccattcatctctgttactgcttcatttactactgctaaattcataagttcctcctaatctgccatactgttttcaagcacagcaatctcaatgatttccttcatcttttccgctgaaatgttgttgtttataagctctacaagctgcgactcagtaagtcccttttcaattgcactcttaatctgcacaagctgcgccggaacaaggtctcccgatgcaaccagctttacaatgtctgctcttgactttttcttaaaagaaagccttgcaaaaaagctcgccactccgctgttgctgctctttctcacacttcgctcaatcggaagtctctgcaccacatttccagagccatcaactaccggaatctgataatagaccggaatcccgtttgccacagcctgcatattctgcggaaatgcaactgtatctaccatctttttatctgcctgttgtacggactggctttcctgcggctctgccttactttctgcctctttcttattctctgtggcaacacttatgatcttatcttccaatgactctattctgtctcccatacgcttcatctccttatcctttttctcaatatcatccctgagtcttgcaatcgtactgcttgccttattcagttcattctgctggctgttgataagagcatccttatcctggttctccttgaccagacgccccctgacttcctcatcatctttggaagtttctatttcagaaagtttcttattcagggcatcatacctttcattctgatgattgatctttgcaaccacttcatccatctgagaaatgagtgctttcacatactcagactcttccggaatctgttccttgactttattcagctgttccagaacttcctcatataatcggcgcatggtgataggtttttcccctttgtccatgacctccttaattgtctgaacaggtacacccttttcataaaattcgagagacacctgcatctgatgaaccgaatacttggtattcttgataatatcaatcacatcttttggaacatccttatgcagacactccgataaaatcttcatctgttcaatgtcgtaggacttattgagataaaggctgatttcctcctctgtcagtccatattcataatcactttttacaagagcaatcgtatcctcgctgaaatgcttatttcggagaagctgcaattttttctcgattgctattgcactaagcggttctctgttttcttccatatatgcctcctaactactaaaaaaacagtctaacgttctggctgttctttcctgtctcgtattgtctctttgttgtactgtgcatcttttccatctgatacgctgtctggaataagactcttccatatagatttaccaatattcaactctttgaatactgccctttcttttgcacatgttttggaatactcctctttataatgtttacgcaatgcttccacctcttctaggctatatccctgtgataaaagcttttgtttcaatgtttcccattgcagatgctcatccgtaaaaaattcatctccctgaaggaaagacttctcagcaggttctaactctttcatatcatctgctatatcaaaaagttctcgacttctctccctagccttataaatgcggcttttctctgctgagacttcttttcttttatctgtcaatgagctgattacactgacaagctcctccgctgaatgaatgtcatgattgacaaggaacaaatactcctcctgcagtttatgcatcttacggatatcttccttatacttccatacctgactgtatggcttctttttcagctttcctatccggtatagctttgcatagtatctcttttgaagtcccgacatctttgcccttcggtatcttctcaccttacacttacaaaggaccggttgtacctctttctgctgttccctgtaaaatgaaatatcctctttttctatcctttcccggattgcctcatcagaatacatgtcccctaatgtcttacatctacgaaatctcgtcattccttgtggctttaccgccagatactttccctgcttgacctcatatcctttgtcagataacagttccagaaactgctcataatttccagcctgcaggatgcaggaatccaggtctctcttaatcatatctgcccacacaaaactgccttcacgatattcgctccagtccttatagctttcatgctctttttccttattgccatcatcaacatcaatgattgaaagaccatattcctgacacagcttattcgtgattggctggatatactttgcccagtctcccttttcatagcggtactttttcccatccacaaaactcacactgttaaatacaatgtgtgaatgaacatgtgctgtattatcatgcaccacatatactgcctcgtatgattttccaagatactcttccacgaatctgcgggttatctcaaatgccgtatcaggattcacttcatcttccttaaatgagagaatgatatgatatccctgccttttatcaacttttccaaacttccgtttggtcgctttcatctgttcaaatgcagaatcaacctgacagttgattgcacctataagccttccatcctgtgttttctccggattcatcacataatcaagagatctcttcagatgttttccgtgaaaatgcccaccacaatccttcatattaaggattttactgattgccaatctttaccaccgcctcatctaccttctgattcagttttcgcatataagctatcagctgtgtcttatcttccttggaatacagcccggcattgctgttaaatactatctgattgatgttaatgccgattcggttgacctcattgatgagttctttcagaatcttccttacttccggataatcatttggtttctgactgataagaagacggatatactctgcctcattcattccattatcacatgccttttttgcaagcatcttagcttcctctggcattagtcttagtgttttcctaacacaatgaactttatctgccatagactcaccttcctctcttacccgtactataatctttaattccttctgcaactgtcactgcagctttttccaaatcatccctgctacttagatgactaatgaatgattccaccaaagcagctgccatttcatcaatctcctttgcataacaggtcttttcaaacaatctgtccagcctcttttcatctgctttcaaactgtcatacttatcctgatactcactgtaatctttaaaatcctttggatcattcctatgtgcatcagcatcaagtatcagttcataattccattcacaaacagtatctataacatcatctatcgggtatggttcaatttcaccattctcctcagccacatcctgtctgtacatcttcccatcagtatctatgccaatagcataatcatgaccttccatatagttaagcagaattgcagcatcttctatcgaagggttaagtaagatatcaaatgtgtctgcccaggcaatcagttcttctggttttgaaaataacgtaacttctgcatccattgcttccttgcacctccttatccgtgtttagtaaatattcaccaaagctccagtctccggttagtccccggcgactgctagatacgcattagagacatctctgtcctaatgccatctagttagggagaaaatctccctaaaaccctctgtttatggaagtgggggcgctttttgcccccactttgctactttgggggcgctttctgcccccactttgttattttgggggcgctttctgcccccacttttatttttactttcgttcggactctggcgtgtacgaattgcgggggcgctttttgcccccactttgacattttgggggcagaaagcgcccccactttgctgttttgggggcgctttctgcccccacacatcaaaatccgatttctcatgccctgactgggtcatcaactctctgattcatctggttcagattatgctttgccgccacaagccactcgttgtaatccttatatccggctggaggcgggcagtcttctacctcatatccaagctcataatactttctcataagttcagctgccgcatttctccccggctcatctccatcaaggcagaaccggatggaagtaatctgcggatgttcccgaagaaatgtttcaagtggtgcatctgcgagcatcccaagtgccagcttatttgattcataatccgtgaagatatccacataactcataaggtcgattgcagcctcaaatactactagctctgtactgttttcatttaccacattaaatccatagttcttatcatttcctgtgacatcacacttgaatggcttgccctgcttatcaaacacgcctctcatacttgcaaatcttgtcactccatttttgtcatttcctttgaaaacaatattgtggtaatgcctgctctcataaatcagtccatctttcaaaaacagatctatgactactctgctgattcctctctcctgattcagatatgaaataagataggaattatctcctgccggttccggtaggacaaatggctttctctcctctgcctgcttctgcgatacctgatgaacaagaggctgctttacaggcttctcaattcttctgtatcctgcgaaatctaaaagccagaacacagcctcttttacactcattccacaaaatacccgtaagaaatctatctgtgagccgccattgttgcctttgtcaaactgccttgaccatctgtaccaatggcttctgttatagatacggatggaatccatctcctttaaagtgtggtatttgccaatcctctttactgtatacccaaggctttctgctactgcacacaggtcaacactctttgctatggcaagctcttcatccgtaaatcttccatccatgctttcaccttgcctttccctgctctgctacaagcggtgacttgatatcaagtgtccggtaatctgtgcttagtgtaatcttaggattatcaatcatgcctttttccctgaaactgaaaaattcacgattgtctccaccgactatgatatggtcaatgagcggtattcccatcagttcacacagcttgttcatgcggtctgtcatcatcgtgtctgccttgcttgggaatacattcccggatggatgacaatggattaacatcatgcttgccgcattgcttaggatacttgatttaaacagctctctcggatgtgccattgcctcatttaaagaaccaacacttgcaaaatgcacattgataggttttaaatctgaccttagattgaccacacacactacttccctgtcaaactggcacatacagtctcccatgacagcagctatatccgccggattgttaaaggtgtgctccgaataaatcggagcatcctttacaagtcttaccgaaaccacatcaagcttgaagtcattcttctttggcatcagacaccgcctcctctccagactcgacacggataacaaagtcacctttctggctgtttatgagagcaatgagttcttccattgtaagttcctgctccataactgcctcctatctggacttttccttcgcatcatatacaaggggaggttctgcaacgataccatcaagtctcttgttcggtgtatcagttgcaagggtgagttttcttaaatccttatcatagtgatatacctgattggaaagtctctcgtccaaagacacctcctgcatatttacctcgactaccatctgtgcaagcatctcagggcttcccatatctgaagatactgcaatgacctcatgcacgctcgaagggagaatataaaggtcactctctaaactctctgccagctcatgaagctcattctcataaagcatggatgctgcaccattgatacccttttcattggaaatcacccacatcgtctgctccggtggaatctcagctatcatcatctctgcgatctcctgtggcatcccatcccttgcgaacatttctttcataatgtcattcatgctacgaacgacaggtgggaagagtcttcttgtgttttccgctgcacacttaaagagctgttcctcgctcattccaagtctttttgcaaattcatttgtaatttttgaactctgcaccgcatccttatctgcactgattattaccttatacacaatagaaagatcctggaactccctgtgcggcacctgttccaaaaatgtcttattctgctctgtattgatgagctggaatacaatcttctcgttagcatccttcataatgctgtccacatcaacagccggaacctgctcatatgccctttccataaagtcacatgcagccataagtgtttcctcaagatcgccacagtcctgatacttcttatacatgtcattgatataaatcgtaggcgaaatgttcctgccttcttctcttaagatgatgccatcaagagtcacattcaccttttccacgggttctgccacaagctccattcctttgaacttctcaggcatataatccataaacttttcttttactacttccttaaaaatctcgtaattcatcatattacggttcctccttaatctaaaaaagcggggaacataagtcactggcttacattccccgcaaggttaattgttactgtttattctttttctttcttccacgaagtcctactccgacaccagtaataagtgcaagtgcaccgattccaagataaagaagcggatttgcattgtcgcctgtctgtggaagcttaggctctgtcggtacattgacaagcttaagtgttgttacaacaacttccggtgcattgtcatcatatcgaagagttacatcgtgagctgtttcatcaaggatatatccgtcagctgcttttgtctcaactactgtataatggatatcttccttaaatgaaccatcctcattgtaagtacagataggaagctccttgctctctgcatgaccattcttgtcagtagtgagtgtatcaagcacctttccgtccttatcccttacttcaaatacaacaccctcgatcggctttccggttactttgtcagttttctcaatgacaatcttaccgactgcctgttcatctttcatggataccttctggatttctgctgtctcctttacttcaaaggttacatcacttgccaccttatatccatatggtgcagattcctctctgagtgtgtactttccgacaggaagtctctcaatcatatgagtctttcctgcctctgatgtccagctctcaacaagctttccatcagcatcaataaccgaaagctttgctccaggcaattctttcttgcctgtgatatcagtctttgaaatttctaccttgatcggtgcattttcaaatgctgccttaaactcgataacctttaccttatctccctgatatgaagcatccacatcaaaaatcttatcagacttcacatagccctttggtgcctcaatctctttgacataatactgtccaagcggaaggtcagaggtaaatgcagcatttccatccttgcctgttactgttctctcaatctgtgtatcagcttttacgattaccttgccatctttgttcacgatatcttctttcgcaaataaaccgaatactgctccttcaagtgcttccttagtctctgaatccgtcttggttacagtaatctgcactttctgacgatcatttgtcacatccattcctgcaaatacaacctttgtattctggtcgatataggaaaggtctgcctcaatcggtgtatcatctaatacaaatccatcaatggtctttgtctcaacaagataatacttgccaatcggaaggtcatcaattcttgcgatacccttatcatttgtcacgatggttgccaccttgtctccttccttgtgatatacagtgtcaagtccgtcagcacttacgatatcctcttttgcatatacatcaaaagttactcctgcaaggctgtccttgaagaaattgaagataaagtcataccagtaacccttcataagagtagtgtctgttacaaattcgccgtccttattgatgacaatggaacctgtaggtacttcatccttcatctctacatgctgcactttgcctgtgtcctctactgtaaactggatatcagttgccttgaggtatccgtaaggagcaaattcctcacgaagagtgtaagtctctccaactacaagtctcttgatcacatgtgcttccttagcatcagatgtccatgtgtctaccacatttccatccttatcaagtacagtaagtgttgcacctgtaagctctgcaccgcttgtgatatctgtctttgtaaactcaaaggttgtaggtgtgtttttatactcgctgttatatacagcagtcttaacatcctgtccctgatattttgtatcaaagtttactgcttcctcatttgtcacatatccggcaggctttacaagctcccttgcaacatattttgcaaatggataatccttaacaaaagcaatctttccattctcatcagatgttgtcttctcaagaagtgtgcctttctcgataattaccttgccatctacattcttgatatcctcgtctgcataaagaccaaatactgcacctgcaatcggtgtattatcttctgaatcaagcttagtcactgacatatcaagcttctgtctgtcatctgagaaagtaaggctttccttgataacaggtgtcttatcatccacatatgtgaatgtcactttctgctcattcggatttaatacatatccgtatggagcttccacttccacaaccctgtactgtccaagaggaagattcttagctgttgcctttccatccttaccagttgtaagagttgtcacaaggtctcccttgctgtaatacttaatgcggtttccgtctgcatccttctggttgtctgctgtgtaaatatcctcggcagcataaactttgaattttgctccgccaagtgagccttccttataaacaaactctttctcatatgagcttgcaagaagtccacccttgaatccgtcaagtacctctcccttcttttctacagtcagctctccgactacaggggcatctgaatattccacggtgatgaacgcatcatttgtatcaccatctgtttcaaatgctgtgtcagtatcaacagagatgttgacatacttatcatttacaacatatccaaatggtgcagacacttcctcaatgcggtagttaccgattttaagtgcctccggtaagattaaatctccgtcctcatcagtaaagaatgaagtatgctctacctttgacggataagttgtgtactgcttcacatattcgttcttatcaatattaaagatcttaaactctgcatttggtacaagcactgtctgctttgtatcggaatccttcttaattacacgaagctttgcagtaaactccctgtcaaggaatactctccatgtctgaggcttgtcaggatgattctcgctgatttttacctcaaatggcttgattgtcttcatgttatgcggagtctttgactctactaccacataggttccataaggaattgcaatggaaactgcatgtcccttgtcatcggatgtgattgttgttgctccgttttccccgattactaccggagttgccttgtcatagtcataacttccatctgcctttacaggtaaagatgatttcaaataagctgtgaactctgcacctgccaataagcctgcttcagtatcatcgccattgtcagataccttgataagttggaatggctgcttgatgacctgctctgctgatgttgtgcttcttgatacctctgctacaaggtctcctgctttgaatacgactcctgttgctccgtccggatgcacgatatcgtttcttgcataaagaccataaactgcaccttcaaggcttgcatcacccttggcaactgccttgcccgattccttgtctaccttgtagatatgaatctttgctgtcgttctgtcattcacaaatgtgtggctgaatgatgtctttgcctgtgtttcaggtaatacattgaaattgaagctatatacatcagactggtttctaatatatgcatatggtgcctgtgtctcttggatataatatccgttagagattggcagatccacgctgtagcttgcctttccgtcctcacctgtagttactgtctcaagagctgtaccctttgtaacaataacctgtccggcatagtttttgatgtcatttccggcataaagtgtgtacttgccgccatcaagagggttctctgtgtcagaatccttctttacgacagatacatccgctttctgccttgtattctcaatcgtagttgattcatactggactgtcacagtctggtccttatactcaactgcaactgtctgaggtgtggtattgattgtatatccgtcaatgctcttaatctcagtaaccacataagttccaagatgaaggtcagataataccacctgtccgtcagttcctgttgtaaggctttctgccactacatcgccagcactatacacctttgtaccatctgccttgtagatatctgctcctgcagttaccttaaaagttgctccagaaagcttctttttctcataagtgaagttgcttccattccatgagctaagcacctcaccctctttatagattgtgattgctccaagctgctctttatctgttgcagagattcccgttgtctgtcctgcttttacagtaagtgtatgaactttaccggaaaggacatatccctttggtgcggtaatctcttttacataataagtgcctgcgacaagtgcatctgactttgcatatccgtttccatctgttgtcatggtctgtattctgtttgtgcatccgctgtcagaatagattccatagactgcaccggaaagcttcactccgcttgactcatctgtctttgtaagctcaccatatccgatgttctctgtcttgaccttgatatatgctttgataggatctgctgtcggtctttcagaaataaactcctgatatccgctctttcctgtaagccagaatacacagcttgatgttgtctcaaccttgccagcattggatgtgaatgttcctgttgtagctgtagtattcacgctcgttgaagagattgtaatactgttgccattcttatcaacagaatatccgctgatgccaaaatcaaaatcagataaaacaccattgctgtcagataatgttgtttcaaatctctgacttccctcattccactttaattcataagttggtgcctcactggttctgcgtgatgcaaaacttggaagtgttgcattgtaggagctgctgatattgtccctgagtctctcataatagctgtatgaagaatcaggacttggtgctgtgttacagagctttcttgctgccgaatcaccacttccggttccaaagatatctgctacaataacccataccattgcctgagttgcgatatactcatcgcactgactgttgcttggtgccgccttttgtgtactgttaaacccataataaaggcagtaacttaaaagttttctctgctgtgctgacattgatgtgctcgcatcatcgtagctgttcataagctgaccgccatctgctcttaatccgaaattcatacaatatgcagaatttccgtcaagaattgaatacagaatcttgccatgattatatccgggcttcagctcacttacttctccggaatttttgactgacgcattccagaacgcaatatttgcctgcggactggctgcaaatgctgttgttccattcgtaaagagtgttccaaccagtgtgagcatagccataaatcctgccataaaacgctttagtttctgtttcatgtgctctttcctccttaaatctcaattagttcagagcctattcgcaaaattgcctactgcaatttttgctcatgtggcgtatccgccaaataaaatttcaaaatcagtcttagaaatgcaagcatttcacaaccgatttatgaaattttgcttggctctgaacgggtacaaaaaaagaaagacataagtttatggcttacatctttcttccttctgcttctattcgtttttatttatctgtgacatcgaaactcgtaatagtctgtgccgcctgtcgtgtaaactccatcataactgatgtagaataccggatctgtttccaaaagtaacatacttgcaatatattctgcgattgcatcctcagatgataaccgctgtccatcaattgtacttgctttgttgaggtctgtctctacaaacacactataataagagccttccataccatcgtaaggataatactcattgtactcttcctgcgtgatactgccgtcattcaaatgattctgtaaattctgctgtgtggtaatcatccctcctgcctgacactttgctgttgcaagtgacacaacattctgtggactgtacgccacggatgcaggctgtggattgctcacattgtctttcggactgtctgtagtctgaccaccattacctgcattactctgatttccaccagcttcctcattatcatttacaggagctttctgttccggctcgtcattctgctttggcttttcttcctgctttgaatcagtttcattatcagcggaccggttatcttctttatcaatcttctcttctgaatctttaacctcggcaatatctttctctgtctcttcacttccaacttcggttgtgacctctgtgacagctttcgttgccatttctacttcttcagttggctttacgctttccgtctgtttctctgtctgattatcagccttttccttaccaccattacaggcagccattgaaaagaccagtactgcggataataagataatacttatcttcttcatagtcatcacccatcccttctccgcaagagggacgggctttgtgttccgtgccatccacccttgcggtgaactatttatctgtaatgcacgggacacataggactgtcccgtattctgtgcatcttaaactcctttcattataccagctctcttattttaaagaaatactgcataagtcgtctgtttttcttataattcaagaataaaccctttgcctgcatatatgctcacctcctctcagaatgtgcccattcttacgaatgaaagaaatacccttgccaccatagcgaatagaagaagaattattctggcaagtcctaagaccagcttcaaagctccaagaattatccttaatatccacttgagtatctctaaaattactgttcctacggctcccataactcttctcataataatcagtctcctttcgacatccatcccattgcaagtcctgcaacatctgcatcgtccataacatcttctgtaggttcttgtgcttcactattggctgcctgcattattaccggctgaccaacattcatcccggatatcactccgcctaacagctttattacctcttttctagcctcattggttgctgcttcaatgacctcttccttaatgtcatcaatatcttctgaccggatatattcagccctctctttttccttcttcttgataacaaaggtttcttttccataattatcaatgtaaaactgaatcgcatctatgatgaactggttcttagatttgaaaatcttcggatcaaggttctgaatcacatcattgattttcacatgctgaggattgctcatgttgaggcggacagaagtttttacttcatattcaagtcttcttcccatcatctgcctccttatgataatcgcttagtgcttttaagtcccattgtggcaagctgctcatatcctcttgcatttgcctttacatcaaggttataggaaatgttcttagcatcatgactaccaaaattcttcatcacaactgccccgcctccgacaaatacaatcggtgtagtctttaagttatacccaaactcacggattgagttatataccttatcaacaaaatcctctatctctgccttaataatggcaaagtattcatcatcaatatctgacctgccatatcgcatgatgttctgtatctctgactcgtctacctctccgttaagttgtcttacacactgttcattgatagaacgcatacaggtaataagaccttttggtatcgtcacacactttgattcatccggtgacttgttgattaccggcataatgtcgattgtccagctaccgatatctactatcagcgttttctttgccattgtaggaatcttgtccactactgctgcataacactgagggaatactgccacatcatcaatttcaatataatacggctcattctcatatttgaagcttacacgcttattctttgtcaggtacttgataaaatcattcttctctgctccaaaccttgtaagtggtagtcctacggcaaggaatacctttgcctctgcaagacctcttcttttaagttccttagcaactgctgcaagagtgagaagataaaagctgtcatcttcgacctttgtatcctttacttcctgcctcacagttccaaccttatagaactttccttcatactcaagtacatcgccgaaaagtgccggagttgttgtaatctccttaactcctgtgacaaatacctgagagattgttttcatcattgaccaaccatgatcaatgccgattacttctaacttgttattcatattcctgtctctcctttccttccgtaataattgcttccatatcctgcacatctgtatcttttctccctccctcttccataagctgctcaataaatctctctgatctagacgacattgcaaccaatgaatatagaaaaacaaggatgatacttattccgaccaacacaacaatccagcatagcttcatgtaaatacgcctccttctgtagattcttctaagaggcacttacaatttgcctgacattttcgtgccagtctttggaaataaacacatttcaaacattcgtgctctgccataaataatgctttctcatttctggctacaatctttcggtaacgctttttcaaataagaaacatcatataaatcctgcttgatttcattcatggcattttgcttcattatcgctgtgttcagtgaattaatgtagctaacgaacttttcctcagtgcttatatccacacctttaaaagttaattccattcactacttacctgctttctacacggctcatgccatgtaggtgtgcttttttcccatttgcctgcacacataggaattacagataagccgcatatgcgtttacgacgcattaagttaaattaaataatgctatcctctctaccgccttttcgagagccaggaagttccctctgaacaccttcatagtttattatccttccgcaacagtattgactacccttactcgctccactttcatttctcaatccttcagcactcttcgcaagtatatttgatttccatcaggtatctgaaccggaattatcactatatctgtaattgttattcaattgtatgagctgctttgcaactcgcaggattatgatatagcaaaattttgattccttgaacttcgccaaaagaagtattttcaacatatctattctttttatgttagtcctcatttgtggtctgttcgtgttttattatatagtccacatttgtggttgtcaatatattttcaaaataatgtaccacttttgtgaactctgtgttaaaatattcatatcaatttgtttgaggtgattattaatggataatagacattcaattggaagtaaaattcaaaaatatagaaaattaaaagatatgacacaggacgaattatcaaaacagtccggtatttatttatctaccataaagaaatatgaaagcggtgaacgaaatccaaaaccagatcagcttcaaaaaatagcagaagctcttggcattagcgtaactgtatttcttgattacgatattaataccgttagtgatgttctttctttggttatgaagcttaatgaacaatcttcattgaaaatatctgctgataaggataaagatggcaactacatccccagcagcatacacatgacatttgaagattcacaaataaatgaagctatttgttcttatctaaattgtaaacaacagatggatttaatttcctatgaggataatgataaagctgtgattgaacagcaaaaagaattttatgatgataagattaacagattgcttttatttaatgaatgtattaaaaaaatccgctaaattgcggattttttctttgctaggactctattataatacttctctttacatatcctgagtagtttatccactactcaaatagctttggtaaatcgttggtaaaaatctactgtaacatccccaaaacactgtaaactcaagtatttttaatcaaggttagtatgttgccgtggcaaaccatgagcactttaattttatcttgcatatcttcgtttttccttgtatatccttatttttcctaggttttatcacactttcacgacatctaacctagtgtacctatcctagcataaaatcgcatattttaccatatctcggtaagtaaaatgagtacaaatctaggtataaacccgatttgtactcatcagtactttttccctatgccctttatttccttacttggcacactttttcatttctttttctatcctttcaagcctctccatttctctctgtgcatcttccaacttaaggtgtgtatacacatttgaggtaacacttatatctgtatgtcccattaaatatttcaatgtttctacagatattcctctctttgccgcattcgtacaaaatgtatggcggcatccaaccatcgataaacactctgcacacatccaaaccctaaatattcttgaatatcttttggttttactcctctcatatccataattcttcgaagattaacacctgtttcttttttattaattgttggaaacatactatcgcctcctagcactaaattcttgttctactcagttcttacacatactttcttccccgaaaaagcaattccaaacttcaagatttccgtaattccatcctctttcatttcagaatcgtatcgcaactcaccaatttgctttaatgcttcattagaccatttttcaagctcaacatcgcttaatttttctttccactttaattccaaaataataccaggataccttttttctcttggaattaaagaaacatcaaatctgccatctccagattctcggttcgatttaatcttatactgattatccattaatgctattaatcctagcatcaaaccatgataaaatccttcagctccaccatcgaagaagctaattgatttatccatatattccccaatagcgctctgcaacttcttgtaatcattggcataaagactttctgcaatcttatttgctgtaatccttgtaattgctccagtttgcaagaaatgtgacaagatttcactcttatatacagctacaatctctctatttggaattgatacttcacataaatatgaaccatctgcttgcagttcctttttaggagttttcaaatagccagcaaccaacaataagctataaatatttgctggatcctccgcaagcgatctatacaccacattttgatcaattcttgcaactactctttctccttgcaaaaggtcatataatctttctgtaatatcatctgtagccactcttagtacatcatcaaggatttcattttttcctgtatttacccaatatgcttgaggaatgcatcccttggaaatatagttgattacagaccatggattatatatttcttcgctaccaaacaaatatccatcgtaccagtctttaagttcctcctctttatctgatactccatagtaactgagcattgctttcacttcagattctgtaaatccaaaaaagctatcgtattcttcatccattaaggagttcactgttaaattatttagaccactaaagatactttcctgagcaatacgcaaaattcctgttaggaaaccataggataaattcttattatccttaaatgctcctgaaaagaaatttctcatgaatccaataatttcatcgtagaaatccttagagtatccctcttgaatcggagtatcatattcatcaataatgattactggagccttatcataatgtgaagcaagcattttcgatagtctttctagcgaagaagtaagctccacttcattagctgtagcgctaataatctttgtaaaatactccttctcatattgtgagagcttatcactatttagtagctcttgatgtcttccatactcttcttgaagtagtccccttattttatctattgttgcgtcccaagtatcaaatttaacatccttaaaagttaagaatatgactggatattttccttgatgtgaacgatactcttctccacattgccaaatatttttatcggcaaaatacttactagtattcttatctgatatttcaaagaacactctgagcatatccatattcaaggtctttccgaatctccttggtctcgtaaacaaagataccaatggcttttgatccaagaattctttgattaataacgtcttgtcgacatagtaatattcttcctgcgcacgaacatagtcagagatgccgattggtaatgatttaacttctgctttcgcaaccatatttttcttgatgtattttccattagacactcttccatccattggctttggagagtcgtctggaattaaccaagatcctttttcttttattgcaccctgtattcttccttttttgcacatatcatttacggaacgtggagaaacattccactctaaagccttttctttacaagttttcatatatatatcagctcctgtcattcgcaatattattcctcatcttacgcaaattatacctcagtaaaacgcaaaaagtcaactcaattcgatattttgcgtttaattattgcgtttgcttaatgttttgcgtcttgtatttttcggcactttcattttggttttttcagtccacaaacttgtttgtagcatattactcagacaagtttaactccactgaaaaaggaccagcccagctgatcctctccctctatcacatccccattgtaatttattcttatattctgctatttttactttgcagccaaaagtacggtttctgggcaaattatagcatattgttgcaagtctattcttacaattccatcagaaaatgttcatgcagcgcacgtttcacctgatcgaaattacctcgctccggacattggatggaaacaaccaatcccttctctgggagaatcgttgtaatctgtccgaatgcgccatcagcacgataggatcctggatatggactgatccagaactgatagccatatcctacatgccagggatctgcagatggctcgaaggtaaatttgggggtggacacctcctgcacccagtccctgctgacaatctgctcgcccttccagttaccctcagccagatagagctgtcccagtttcatcatctcggtacaagtcagatacatacctccgccgccattcggatgtccctgtggatcatgctcccagagcggccatcccatatcaaggggctggaataccttctcatacagatactctcccatccgcttgccaacggcccgttctaccatatgagcagccagaatactgtcggcagaggaatagcagaatgcactgcctggctccacaggaaccggctgtgccatcatatatttctcataatccggtgcgccgatgcccggacgtctgtccgcattcatcagaagtgccttaccaaagccactggacatgcagagcagatgtttcaactgaatcttctccagatttggatccggatttgaaggaagtttatctttaaacacttccgccacatgatcttccaggcttagttttccctcttctattgcgagtccaactgctgttaccgtaaaactcttggtatgtgaataaatatttctcggtgcatttgctgcgtagtgcatctcacagagtaccttgttctcatctccgacactgatagcttccagcggcagattgtggctgctggcataacgatgaaattccaaaaacttctcttccagtaacataatacctctatccctttccggcaaatctctgatgtcagtccgatataaccgatgcgacgtgtcgcaaggttaaaaccaatctatctgacatctccaatctggttctattatctcatacacatctctgcatctgtcggcagtggcatcagcggtgcggacggcagggtctgataccaataagcaacactggtgtaatcatcgtaacgcggtccggtccagcccatgttgtcgagtgtcatacgaaacttattctcaaaacggattgggtctgcaatatggaaatgatacagcaggaatctctgctgtccgttatagaattcccggttgtctccatagattgcatacatgccggtatataagccgctgaaggtctgatagctcttgatgatgatgtcatttccaaatccataggaaccgccgaagtagtcttcagttccggtatagtggatagacggatacggatcatcgtccagatacatgcgggcttcgccttctacccaacaggtattgttgccattcataccagttgccagagtcacaccgacaaattgtcccctgccttcgattccgtcaacgattgtgtaggtacgacccttctgaaccgggtgctcttggcgataggtggcatggaaataaccagcctccgccggaatctcctgataagctccggtgataatataatagagattttcatccttgtcaccacggttttccatcgtgatccgagctctcttatggaacggcatctcaaaatagctgttatagccgcgaccaggagctaccagcatcatggcagaattcaacaccggatatttgccatcccggtccacgaaattttcatcataggcacatccgaagaatgcagagagcggagcttccacagacggatattcctgatcatcccaatacatacgtatgataaaatggtgcccaacatatccggtaaaccacatatgctggatcacacccggtcctgcagcatctaccagagttacggtttcccctgcaggaatcgtcacggtcggacgaagcttggtgcagtcaccgccctgggaaccacctgcgcgtacaccggttggattctctgcggaaaatgcaaacgttttggagttctggatcatacaatagttgttcatattcttctcctctctgatcaaaccttgatcatctgaaattattgcttactacgctatcgcgtttctctattcactataaattcactataacatttatctcccatgaagtgacggaattacagaatcattccgtctgcgccttctcattttcttcccggataatctcctttattcaagcgcttaactgattataccataaatctatgaacaaagtttatctgtaaagaaaattgatacagagtttttcaaaatcggtccatctgctcctgggtagccacctgcctacaacttgtattgctatttcctatcgttccgaacaatgcaaccattgtccggcaactgtttcaggtaccaacaattcatacacaatatattcataaatgtccctcaaatcctgtcttgcttcagcggaatatgccacataaaaaatcatatgccaaaatctattttcatttcaaatggaattcccttttgcaaaacaatctgccgtagaaacattcctactgcatttgacattggaattcctaactgatctaatacactttcagcctgttctttaagttcaggctcaactcgagcaaacacatttgctgttcttgccataatcatcgcctccttcaactgtattctgtcatagatgcttacatatggatattatgagtgcaaggtgactattttatactctgcaccaaagtatcctgccagcatttctctcctccccacaggaacttctttcaccacaaatcatattcattttataatattttctctatgcacttatttacgccactgcattagcattaatctggtcgataaccttcttaatccccatccatactctcatgtccgtaaatatctcaaccacactacccttatcagtaaatggagactcttgaagcactgacaaatctttcatcataccattgtgcacaatgtactcaacaatctgattcacaaaatatatctgtctgctgtcaagatttgtatcatttaaaaactccgaaaacgctgcctttgcagcattcatatcaagtcctacaatctcacgcacaaactctcccaatggtttatgtccatattccttttcataatcatcctttgagcctagttcattccaaagaatctgctccagactttctatatccacctccgtcaacggctgattggttttaagttttgcaattgcaatattatcctgatgctggcgaatataaaattccactttagccttataatttttcaactcatcattttcaagttctgactcattccactctgtcgataatatttcatcagtaaagtctgtatcatattttataattcccttaggcagatatttcataagattacggaggctaaccctgatatactcaaactcatcaattccagcattatctacataatcagtatgaagaattttattaataagttctgactgtacctgaatttcaggaatatttgcaacacttgcaataccttctacctttttgaaaagatcacttttatgtctgccaaatccctttcctgcaagataagccaattccattccatacatcaaagcatcaaaacgaatcgcacttacttcatctccatccggctgaattaacggtgctaactcatcacgaaccatcaatgtatcctcaaaagtgattgattgataattactttccactgaatatgtatctacatacttaagatgctgccttactgcaaagttttcacggttcagctcctgcaccttgcctgtcatcttgtcaacaagtttgttcctgtaagcaataagtctgtccatctgatattcaatgctttgaagtttatatgtaatttcaaattcaagagaaaaaaccgccccctgtaaagcaatcatatttgctgttggtcttccctgattcatacgaaaaaattcaaagtttccacaaaaatcaaagatgtaaaacttgtccttatcccctccatctataagtccaggacacagtcttgtaccacgtcctatcatctgccaaaacttcgccttactcattacctttttgaaaaatacaaggttcaacacttccggtacatcaatacctgtgtcaagcatatctacagatatagcaatttgtggcattttgtcagcatccgagaactcatctattgcactctgagcatatgtcatatagttatcaattacttttgcaaaaggctgaccatttttactaagctcaggatactgcttgttgaatacttcaagtatcttctccgcatgatcatgatttttggcaaaaataattgttttaccgattttctgaccataatccactttaagtccatctctcatcagcacatgaagaacctgtttaatggtatcctcattaaatacccatgtatttaaagcagccgaatctattctctctggcagtttaccatcttcaaattcaaaagtatcttcataaacagccttatcttcatccgacaattcatcataagcgatgccttcttcaatgaatttagtcttgctttcaaccgttacaaaatctacaagatagccatcttttacagcctgtgccagctcatatccatatgtaggcactccattttccaaatcaaatatttcataagtatttttttcaatctcatccttaggtgttgctgtaagacctactaacggagcatcaaaataattaaaaatatccctatacttgttgtaaatagacctatgtgcttcatcacagattacaagatcaaaatgtccacaagtaaataacttaccattatcatccctgactgaatcaatacagttcatcatggtctgatatgtagaaaaaatgcaatgcgctgtatagttatctttctcctcaacaagatttgagcaggataaatctggcaaaagacttacaaaatttctttttgcctgtgtaaccaatgaattacggtctgcaagaaacaaaatatttctaatccagcccgcatccaaaagtaccttacataatgcaatcacagttcttgttttaccggaaccagttgccattacaagaagtgccttcctacgattgcgattgtaaaatgcatcacaagcagccttaattgcagcttcctgataatagcgtcctgcaatattcttatccactgaaatatgtctcagacttgtcttcattttttgaagattgaagagcttttctaaatctctctttgaataaatagccgcaacctttctctccggatactgattatctataattctcgtctcaaaaccattcgtaagaaaaaccactggtcttctcttatattttttctctaatatgtcagcataaagctttgcctgctgcctgcctttcgccacatccacacatgttcgcttcgcctcaactacagcaagaggcttatgactatcatcataaagcacatagtccgcgaagcccacctctgatttatttggcattcccgaaagttcaacttcattaatccagtcttgcccttctatccagtcagcatccagcaacatagaatcaatataaatttttcttgtcttatactctgataaatcaagaggttttggaacataagtcttctgttgctccgtacgcttagctgtcaacgcttccttaagagccttattttcagcaattaacgcctgcaaatccacatcagtatccgaagatttagtcacctcaggattttcatatgtttcattcaacagatttacatcatactgtctctctttataaaaatcagaatagcagtatgacacataatccataaaaataaacaaattctgcaaacaaagaattgcctcgtcttctgtaatctttctaccattgtgcgcagctctattaccaatctttcgaatcaaattcaaacgtttccataaagtatcatccacaagatcatgaaaatcttctgtgctcataaggctcataagattgtcctgataaggcatctcaagtgatttgtctacggaatacatccacttgatagcaaattccatggcacgacgacaattaatcacgctggattctttgtctatcttaaggactttctctgcggctattgccacatccgagaaactattgaattttggttcttgtttcaaaaaatcaaagttggtcatagaaacctcccattcatatactattcttgtttaattaaacaactccggctcatcattatgcaattccggcaaccattgatgtggaacaaatgttaatattatttcattattcctccccagagtaaatacttgttctggcatgtataaaaagcaattatttatcaaatatattgtatcgcctgaattcttatccaatacaactgtcttatcttcactatgtaaaagttgaaacacaatattttttgacgagggcttagctttttaaacttattttttaaattttctctaattttcttctccaatatttttaacctttgaaataacagaaaaaaacaatgttactataagcgcaactaacgctggtgtaatctttttaaaattatcaaatatttttctgaaatattatctactgatatactcatattatcactaatcctttaagaaatatattcttccaaaaatttttttaaagcagctaagcttctcttctaaccgcttaactcgctctatttccgctgaacaattcataatctttttttcttgattatcatttttccttttactttcagataaggcttctttcagttgttcattctcctttttaacactttctagctcaatacataaattctgattagtagaattcaatgactctatttcatctaatattgtctttgtcactttttcatccccccaattattacgatgtgcaatcgaatctggttttatttctttaaataacgacgaatctttatttttatcaacatatattaatccagcttcacattttatttttttattaccatagttagaacaccctaggaaaaaatgtttacttgctctctcactttcatttgttgaacgataattcttatctttaaaatataattttccaacattacagcacgtacaatgtaccacatctgtccgatgcaaatttatatatccaataacattccttattctggtttctattttctctgttctttttagaagatttatatgttcttcttcagagatattatgttttttcaacatatctataaattgtttatagattacctccatcttttgtatcccgtcgctggttgttgccaacaaataaacaagtttattctttatatcatctaatgaaaacacatagtcattcagatatactgacggcacatttggaacacatccgttttccagcaaaacttcaaccgtaataacctgttctctaggaattttaagttcagaacaaaacacttccttatgtgtatgattctgttcaataggattagaaactggctcatcatccatcaaattccataacggttctttatagtcgaactttttgtatttttcatttttcacttcaaaaaggaaaatcaaataaggtgtaaatacaacgatgtctatctctgctgttatataccctcgctcaccatacacagattcaaatgggaatcttgcattctgtattaccttacattcaaaatctaactcaccaagcatcgaaacaatttctctatatactacagtctcacccattgctcctttttcttttgcatccaaatctatactctctccttatctataaattgcaagcacctcaaccattctatactgatcatccacataaattggactaaattcttttcctctatcccccatagactttctcatcattctgttcaatgccataaaatctttaagaggatcataataaggttttgtactacttacaaactgtgaagtaactcttgccaaaattgttatattctcatctatttctgataattcttcataagaaatagtcatattttcttgaaatattttcgaacaaaacaatgtatcttctccctcaaacacaagaggaatctttgctgcatttgcagaacccaaaaatgtttgcagtgccattctgctagcctcttccatatcttgaaattgattcatattcaaaataaaaggtttaaatgcatcaatcactttcatcatgtcaaaatcttctgggatttctatatatccatccattttaataattgagcgatttggaactgtagtaatatcgtaatctgacgaaatcgtgaaatcaaaatagtcatctcgtcctattaacattttttcaaacaaatcacaatcatataaatcagattcttgcacctttgctttatatgatttagatgcttttacatcagcactaactaattttaaatcagcaattattcccttatcattagatacatcatactcttcaatttcaagatttggttttccactaataactgatttatattcagccactgcctttttgtcgtaatatattatttttccgaacattatttctcctttcaaacgagatatcatcacataaacaatcctataaccactgtttctattcaaatgctttctacacggtaacttttgatttgttgacttgattcgcaaacacttcaaacgctatttgcttctctattggcggaataataaaatcgagttttcccagtattttcatagtcaagtacttcgttaaaccgcctaacgattgctgttgcaaataaacaagtttatcctctaactgatatctaaaaagctgataagaccagtcctcttttaatcctaatacataagttctctgatatgcattaaacttgccgttatagtacttaacatcatatttaccagccgcattattaccagccaaaagtaaagcttcttggtcaaaagcaaacttatcaattctaagaacttcttttgaacaagtaaaaaatggatactctccatcctcaactgcagcattagaatctagctttcccgtagttgtgttaaaaacatcattccactttagaataggatagcctttgtcataaaacatctcgacaaatcgggctttgatgaggttgtctaatgcaagtaattcttcttgtctgagtttaataatcgtattaactttatctaatttatttattattatttcttgatttgatatatctggaatatatatatctatatcagatacttctttgaggtatattcctttttgagctacaccctttgctctattttcaatatatgtacgttttcctctcaaagcatacattaaaaatctaggcaaacaaacatcattctttggatgaagcacagcaacgcttctctgtaaagcaaatgctggcatatcttcatctacaacagctgttcgcccaacagttccaacaatagtaagcaaaacatcgcccactgctatctgagttcgcttgtgttctctttcaaaatctttttcagagagaaaacgcggttcatcaaatgttatttcatcatcaaaaatattttttgagctcaacatcatatattcgcttttctcaattccttgcggtggattatgacttccatctgttacagaagtgcaaatatctttaatcttcatctacatcatcccaacaaatccgaatttatattataatcacgctatatatttttgatgagatgttttaacattattttgattcaccatagcatactgcatagtagtatctatttgagaatgtcctaacaacctttgcacctgctcgattggcattcctttatcaattgcccttgttgccattgtccttcgaaacttatgcggatgaattctttcaaggtttaaagtccttccaatatttcgtaatcttatctcaacgccactgatttttaatctttcatatggagcgtccaaagtcacaaataaagcctcattattatcaatcctattttcaagatattgttttaaatgaaccttggtctttgcatcaaaatatactctccgctccttgtctccttttccgtaaacaacacattctcttccttcaaaatttatatcatctatattaagattgaccagttcccccactctgattcctgttgaatacaataaatcaatcatagccaagtctcttttttccttacagttgtcacgtagtttttctatttcttcatccgagatggtatttttgacaatctttttcgttttaattttatgtattcttttcatcggactttttaagatataatcttcctcttccagccacgaaaagaaacttgaaatatttctacgaacattatcaatggttacattagagcaattgttacgcttctgatagtttgataaatactctctcatttcctcagttgaaatctttcgaacatttttctcagtacacgacaataaatgttgtactgttaccctatagtaattaatcgttctttccgaacatccctcaattctcttcgctgccaaaaacatattcaaaaagtcttcattctttatatttacttttgatgcttcattttcagcaaatgttttaataatcacctcttgcagttttttcatctgagtaattgataaatactctgacatttcgttcaatactattacaattttttcttccatgttggtttctcctcatctgataccaacatcctacaaccatattctttataacatcttattttccttatagcattcaaaaatgtagttaggattttcataataaacgctgctattgtaatcatctatcttagaactgataaacgaactgtacacttctatcagtgcatcaacagtttctattttttcatcatctgcaaccatttttatcaagcgtttgtacacttttcctatatcccaatgtgatggcactgcgtagccacaatcagataaattatcaaattctcccatgtgaatatttgcgtcatcaataaaataatcactaacactgtcaatattatcgcaatgatatacatcagcaagctcataaatcttgctaattctagtctttccaagtttattcactacatcagcacgaatatttttcgttttacgagaaatgtattcgattagactgcaagtaaaaaataaatcattatcctttttattttctctttcccggtcagccactatcgcacctcctcaaatcctctataattcaaacattttaatgcctcatctgtgcagaaaactatctgatatgtgggatatttaaatttcgctaatacccagaactgttctctggtaatagttccgtctatataatcagaaacatagttataaatctgatcatcagccatagctccaatcacaatatcataatcatgcggctgtccacttctgcatgctacaatgaaatcaagccattcctctgtcatctctttaaattccataattgttaattcagagaaaatcttcacatcatatattgatacaatttttgtattgtaacgtcttgcccatctttgtgcctgttcttttattattgtacaataaaagcccgttccaaagtcctttgtgtttttacttgctcttatctctggcttttcaactgcttgatatccgccatgatatactgtcagcaatgccatccccagcctccattcaacttcatcatataaaaataatttatccaaaatattattacatctatcactcaaacatcagattttttttacaatattttttatgttatttcaccctagcttgtcttaaatcgctttattcaaatcaattgcaaaccccatttctcgtaattcctttaatacttgaatttcccacatggtattatcagtataaaccactccatataaatcacttggcatttcaatttctttatttgcaagtagaactacattctctcttccaagtttaccaataaaataccctgcttcaaatacaacattctgccgtgctctaaccttcaagctttcatcagctttagatttgcccatatcatcctcagtaaacaaacaaattgctgctttgacctcactatttctttcaaatttttctataattgttgttcccaaattcacctgttctgataaaattattggttcaatgccttgtctttcaagtgttctagcaatcgcattttttaattctccatcatgtccatgtacaacaaaaactttattatttacaggttcaattttattttcattatttgctaaagtatcctctccatcttctctttgcagttcttcaagatatacttcaaaaattgcttttgtctttctaagcgcatctgcacaagcttctacccaagcactatcaggtgtactaaaggtccacaatgataaagtaaatgaggtcttgacaaaatcattatactcatctccttcattgtaatataattttaaaaatctctctacttttttatgccatttaataaactctgtattcgaactagtaacatggtttgaaattaaaatatcaatttcgtcataaagcgccttaaactgattatatttttccataacagcctcctattatttcgttttctactttctaaaattttgataagcaaaaactatatctcatttacttcttcacctactatcataaagcccaatgattcaataaacgattcgaccagtccatttgcaatgcaaattgccgattcatcatcacttataattgaactttttatcaacttatttaaattattgattgcttcttctatttcatctctattaagcaaacaagctcgactatttttcatacgatttaataatgaaatatacatcttgattttatctttgttatttcctatatagttttgagccgatttaagcaatttttcatattcattttttaattgattggtatatgctaattggctttcaaatatatctaatttttctgatgcatgcttcgccttgtcggctgcttccgctgcattagtttttgctttatttgccgaataaaaactaataacactaaataacaaagataatactccaattgcaaaagaaaccatattgtatgggctacctcctgtaaaaaaacaatttaattcatcaattatattcatttacttcacctcatcaattaaaatattcttgcatcaaactatcaaataacatttgtgtttcgtctaatgctttttgaactgcaacttttgatttgtagacttgttcaataaactcaacaaattcatcttgcttttcttttttaggaacaattacttttaattcactaagaattttcaaattaatattcttttgtgcggactctggagcttgtgactccagtattgcctgaaagaacgaaaaccaataatgaataaagatattattagtcttctcgttcgcaataaatccaactacactatcaggaaaacatgcatcaaattctaatattgctgtttttgcaatattagctgcaattgtgatacaaagagtacctttgttccacatcttactctgtttcaatcccagttctgaatatgtaccgccatatgatgtaatatacaaacctgcattcgctacatctccagtctgaatcagcggataatctccccctaatagtttagaatcatttctaggtctatgttttgatacaccacgccccaattctccgagttcaggtaatgttgcttcaggaaatccataagagttcgatacaggatctccaaacatctcgacaaatcgggctttaatgagaccatctaaacaatttaattctttcttatacttttttattacactatacgtttttcctaatatttctgcatattcatattgtttttcaaaatcaatagctggcaccaatgtttcttcaagcactttcctgcttatcgccttgaatgtactaccagtccccttactattaagttctgctttcttccacttaagtacccagtaaataaattctaatgatactttacttctatctggtgttaaagcagcaagtcctcgtcctatacaacattcttctttagcaaaattcaaagctccaataggtgctcttaccgatattaaaatatcattaggttgtgcaacttttattggtgcattacaccatactctagttacaggatatttctctccaaaatctgcatttccttggaaaaaaggaattccatccttattatcattataactagacgagtcaggcgattgccccatatttattttacaaatatttttcaatgctatatattccatctacaccatccctgcaaattcacattatcaatctataatacttttcaattttgtcttaatatctaaccatgcattttcttcatccacccaatttatagtcctattctcagagtccattcgctcacaaacttttgatttcttatctttttccaaacatattattggctcaatcaattctccctttttgtaaaattcccaagtaatacagttagttaatatgacataatcggcttttcccatatactctttaatttctttatctgcatgagttctctcgcttttagaatttgcggttggacgtttgacttcaacaattatacgtggtttttcttttctttctgcaaataatttccaattttttatcacaagcaaatctggtgtaaatttttctgcaaaagttcctctacaaactccatttcccatgtcatccttatacctttcccagtttcgataaagtgtactagaatcaaccacatcataaaaattaggactatatttctcaagaaatggaattataactctattttgaaaattgagttctctacaatcattttgataatatttttcaactaactccttataccttttaaattccatagttttatccttacaaatccgaatttgtcttcctttctattctatcatttcgcactaactgcaatcaaataattcacaaaagcactacacgacaccaacataaattttgcttcttcaaatgttgatgatgatccaccaatattgccagcatgtcttattccattagcatctgatgtatatccgtatagcatattaaaagccgctttcagtcctgcatgaatcactacaccattatcttctaatttttttaacagttttcccaatgaagcctcttttcctgttattccagtaagtatttcacataatgcttcaaccgcactaatactttctttgatagaattctcataatcaggagatgttctatctccaagcaacttatttgctttggataaatgctcatatacaggcgaatacggattatccaatgcctgttttactgcttccagctcataatcatcacttattggtgtaagttgctcatctatgaatctatatcctacatattctctttgtaaatatgaattggcaatttcataaatagagcagcttcgataactattatcataagcattataatagtcatatcctctcacatctattagatacgaatcccaatactgaataattgcttctatcagtgttaaaacatcatcataatcatcctcttgtatggtattattaataattttaaacacttcatcatcataatatgtccgactagtatccaccgtttccgaataaatagttcctataacatatctaaaaaatttctgtatatattcctttccgcaatatgtattaccatatatatccttataaaactggctaatcatattttgcaattgtactctagttctcttatcaaactcttttaactgaatctctgtattttccggtttgattttattcctatcggaaaatccacctcgtttacttacttttgccataatatcattctcctaacaatcttgccaactcttccatctcgttcccaatctcaatctcaatctcacgaatattagccataatctcagatgtaggcggatactccacaggcacatactccacttctttatacttgttaatactaagatcatacgcattatcaacgatttcctgcttaggcaccataaatgacttatctgtacgttttctgtctgactcagcatcacggttacggaatctttcaatgatatccgtaatatcattatcagcaattggagaacgcttgtcatccagactaaatccatctgcctgcatatcatagaaccatacattatctgttccaccatgctctgtctttgtaaaaatcaagatagctgtcgatactcctgcatatggtttgaacactcctgatggcattgagataactgcttcgagtctttgattttccacaatttcttttcggatatccttatgtgcctttgaagaaccaaataatactccgtcaggaacgatgcaggcacatctaccacctactttaagcattcgaacaaataatgctaagaaaagaagttctgttttctttgttttacacacctttaacaaatctgctgatacaatatctgcatcaaggcttcccttgaaaggaggatttgccagaatcagtgaatatttatccttatctgtattctggtctgataaactatctctgtattctataaacggactttctactctatgattcatcatattcatagcgccaatacggagcatcgttctgtccatatcataaccatagaacatatgattcataaaatggtcttttttctgcttgtcataaaaaatttcatctttcttattagcccacagatattctcctgcctccacaaggaatcctgctgtaccacagcttggatcacagattacatcatcagctttaggattcattagttctaccatcattttaatgatatgacgaggtgtcctaaactgaccatttacccctgctgtggctagttttgaaagaagatactcatacacatctcctctagcatctgaatcattcagttttgccatctgcatatataaatcatccattgcatccacaactttagaaagcattaatggtgtaggcagcttgaagattgcatcatccatatattttgaaaaagcactatctttatcagcatgcagattcttgataaacggaaataccatttcctgcactacagaatacattctatccgctggatagtccctgaaaacagaccatttaagctgtgttccatcaatagttctctcaccaatttttacttcctttgcaaatacactttcgtacggaagcccaagcatagcactttcttttgcatgtgtattatctgatacgtctaaatcatgaatgaacatgagatatgtcatctgttcaattacatctaatgggtttgtaagacctcccgtccagaaaatctcccacaaactgtctattttattttttaattctcctgttatcacttttttaagtctccttatcccagttccatttatactttgtataacggccatttccaatctttattatcttctctgccttgactaaatctgttagtgtccgctgcactgtcgttgtacttattcctgacgcttctttaacaatctcagcttttgtgattgtacctaaatgattttttatcaattcttcaatcctatccggtttaggtattctctttttctcaacaatctgtgttctatcaaaaaattcacggtatgctgcggtaattattcccagaatatattttacaaaatactcgtaattgttctcgtcttccatccatccttgtgaacttgcctgtaaagcatcataataactatcctttgtcttctctatcagtttttccaaactgatatattttccaacaatatagtcattttgatataacaataacaaggtcaataatctgctcattcttccatttccgtcaggcgataccacattgagaccctgcaagaaaacgatagttaatttccactctttgcttacgatctctgccggttccctctgcctgatatacataaatactatcaatcagctccaccagcatagaacggttcagttctgttactgtttcatacttacgaattgtttccaaaaattgattggtactctgtgttttcttttcttccgctctgattttagttcttaattcgtctcttttttgagcaagttctttctgctcactttcataagctgaggacatcttttcaaagcgttcatcagaaatcttaccgagtgcattctgctcaaagagcttcataatcacattatcaatttctgcaatccgtttttctgttacttccaagtctttctcgaactgtttgattttcttactgccgcctttttcgctcaattcgtgcatttcctgtataaactgatctcctaaggcttccatattcttaatatgcttttgaatatcactcataacaatctgttgtaacgcctcataagaaatggcatgggttgtacaaagattgctattccttacataagttctgcagcgaaagcgaggctcccttccatttggattagagaatgccatgttgcgaccacaatccgggcatttcacaagacccacaaatatattaggacgtcctgttttattcggctgtttttttacactgatgaatttctgcaccagttcaaaggtttcttcatcaatgatcgcttcatgggtgttccgtactatgatccattcttctttcggaactgcaaccggcttcttattcttaaatgatttggtctgtgtcttatgagaaaccatatgtcccaggtacacttgattctccaaaatcatcttcacattctttgctacccaatccgttggaaacttaaatcctgtacttgtttccagagtgccgttcttcattgccctgtatgctctcggaatcagaacaccatcctcgcacaaggttctcgcaatctgatgaacactgttgccctgtttcgataattcaaaaattcgtttgacaataggtgctgtatcaggatcaactaatagctttcttttgttctctgggtccaccacataaccataaggtgcaaatgaaccgcagaacccaccactcaatgctgttgtcttttttacgcttcggattttctttgatgtatcacgagcataatactcattcataatagatttaaacggcatcatctcgttttcatcaaatcttgtatcgacatcatcattcaaagcaataaacaaaatatcattattaggaaagatttcttccacataatacatgaacatggcattgttacgtccaaaacgtgacatatcctttaccatgataccgctcggttccggatcgtccatagcatctttaatcatacggttcagatccggccggttgaaggtggttccagaataaccatcgtccacatattcgcctatcacttcaaatcctttttccttagcgttgtaccttaacatctgcaactgattggtaatgctgttgctttccttatccgcatccccatcgtctttcgataaacgtgcatataatctaactcttagttttgtctgctgttttaacatttctgctcctttccaacagcaaacaaactgctttgtactttataattataacacgtttaagcactcttttcagcaatttgctctactgttttttcaatcaacgggtattgttttcctgctcaatttctttctggatcagtcgtttaattaaatactctaactgaaccgtaccggaaaaaacggaagttacataaaaagtcgtattcccaatttggactgcattctcctgtttaggattttccatgtgctcacctcatttccaggcaacaaaaaaacaccatcactggtgtttttttgctcctatatatttacaattcttcgtgcatatactccgctttttaggtctatctctgcataaaccatactactatcgccaaactctgtctgccctggctgaatacaggttgtagtacctatctgattcatccatgatcctttttctgtatcaggactttcgtgaatatgcccgtgcatagaaagtaacggctgtttggctttaaggaactcataaatatctactgatcctatatccaaatcctgatatagaagctgccccaaacgcaatccggcaggaggcatgtgcataacatataccgttttcttcggactctccggttcaggcagttctttcaaaattccacacatcaatggaagttctgttttggaatactccaaccagtcaaaaattctgtcataaccatattcattcgatataccggcaaaaaagctaagttgtctttggggaatataatctgtctctgtaacaactcgatccttacatccaaagggatgatccaaaatctgattcattccaataaattcatattcgccaacgcaaatttttttacctgctatattatgaacatttgcgaatcttccacaagtctgttcaaaaagattatccacagatagcaaatcgtcattccccagcatattaaggtatgtaatgttatgttcttgcaatatggaaaagtaattacttagaaatcctttgataaataacggttgttctgtatgtctttctcccaattttggaagcatatctccaccattcacaataactctgatctcttgtttcatagctatttctaatgattttctgtatttatttttatctccatgcaggtctgtaacataaagtattttcatgctgtatctcactccttatatcctttaagcatttgcatcttgattgattataacacacagcaacaatactttcagcagtttccgccgctatgttttccacctgtagtatagatcaccttcttcccacatttttatattttatcatcaaaaccacatgaataggtcggatctatggttattgcacacataaatccggcccattatatctgatttcgattttactgccgtatttgccacgcaccccggcaagtccttctgttataaggacgggactgttacaggctgcggatagcgtcaccgcatcatagtcccgcatacgccgccgctttgccagagcaagcaaacgccgcaggagctctccccaagtctttaggaagccgtgaagaagtaccattatgatctgtgtcgttatcgcgtccgacttgccacagccggttttgtaggttacgtttatcgctcggacagcctggaatcaccacctccttaggccgcctgtcaccgcgccgtcccatctgccgctcggaacacagaatgaagtacctgtaacagcgtatattcggttgtcaaggaacaagcaaggggcatggcagacaaattgatattacagttggggtgggatgatgtatgtgcttccttaccacacccgtccggcttgtcccgccgaatatgtccctctattattcagtacatttttcagttaaaaaagggcggggtaagctaaattttttcaaaatatttttttaactggtgcagaccacggttaatgctcttgcgaacagaagaagcatctgttccttcagctcttgcaatgtccgtcttactcatgccaagaaaaaagtgtgcatagatccgttggcgctgttttaccggaagtttggaaagacctttataaatcaactccgtcatttgacgctgttcccaaatttctgccgggttaagaggcttttgcaatatctcacgctcaataccttcgtctcgatccagagagtaaaatgctttatagcggtatgtacgaatccgataggcttcttccaacaacatatattcccgaagcaacaaagcaacttcatccggcacctcaacgatcatgtcctgtgtataatacgggtaataatcccgaagattgattttcttcatagtaatttcctccaatttcgatgtttgagttgatggcaaaaatcgaaatcagagggtgggctgcggcagcgataaggtctaagtctctttctgattaaaaaaagggtacaaaaaagcgcgcccgtacaaagaacaggcgcgccaaagcaacagtatgaaatttttccgggaggttgacagcgaaaatgctcaaactttgtcgaaaccaaaaacgccgcaatccatacgagctggactacgacgtataggtgactgaatgtaaagcagtttatctgcagatctgtgttgcatagacgcataggcatttcctcccatcaaggaggaacctgaattggctgcttgatacctccttgggagaaaattatatcggttatgtttcctttatcagtccgtagatattcgctttttactctttatattcgcaattttctacatattctgctcttagaatatatgctgcaaaaagcaagcccacaagggaaaacaacaccttgtgggctcatgttatagatgttcaaatttatagccgatcccggcgacactctcaatatagtttggaagatccggttcaaagcgcaatttcttacgcaacttacttatatgattatgaatcgcttttctcgaatagaaatcacaatcttctttccaaaccaaatcggtaatcagttcgtaagtaaaaacacgtttgggattggcaatgagtaatgccagtatatcaaactccttacttgtcaggttgataatccgttcacgaaccctgacagtacggtgttccaggcatagataaagctcgccttcttgtatttctgtcagaggatttttctctgctgcggaagaagtgtgacaggaattgaatactgttccatgacagactccttgctccaaaatatattgcattagagcattcttttgttcctcgttaagaagcagaaataacttttcgccaatctgtttgccggattcttctatatcaaaaacagctaatgtcccatcacgtcaccatcccttttttctaactatttttttcttcttagtgacagtcaatgtgctgggttctttctttttatttgcaagaataatcacagaaatcaagaaagtcaaaactattgtgatgaaagcaggaaaaatgtgataagtataaccatattccgcaccacaagtagggtctactaaaatcatgcttgctttaatcggataataatttaacagtgttccttcaaaagttccgaaatatccatacacaaaagctagtgcaaccccacccaaaaaattatttgccgaacaacaaaatagcaaaataatcggcaagactgaaatataaatccctatattcgccccagtaacacgaataaacatattaaacagattgccaaaatgcgctcccggaaatccggcaataatgttaattactaatgctatcacacaacctataaggctaaagatgattgtcaacaacaatagaacaagtagttttccagaaagcaactgtttatatgggataggaattgttgatatattcttcatcgtatcgtctgtatattcccttgttataatataacctgctatcagtgcaatgataatcggaaaaaacaaggtacagttactaatcataacttgctgcataaaatagtcaaatgtccatgtctgtccaccgttggctgtggaataaaacagtgacagcagcggcgaaagcactgtcataataattccggcttttattacggaatagcgttttagttttaaaaattcagtttttattatatttcccatatcttttacctcgtccatttcttataaaagcgaatgatcaaccacaatgaaagtgtaacagtaattgccagaataaaaattgtatggcaagtggttggtacaatcgcataggcttccggcaaaagattgtctttttgcaaatgatccatcattaagccgcttgtccagttcataacacatataactgggaaagaatttaagaaagcaatttttgcagcacttatagatgttccaactgtccctagtatgccccagttaaaaatagaataaaaaaacgcaagcaggatagaaagcaaaaaacttttgttaaaacaaataattaaaaatacaatcggcaaagaagctgctacgataagaactccaaaaataaggctcataaatatcttataagtcataccataaaccattcctacatgaaacagtttacaaaacaacgcaacagataatgtgcttgtcagacaaaacgcaatgctaaaaataaagagcatggaaatttttgccataatgagttgtgtatttgtaacaggaattgttctaaggtttttggaagtatcgcaatctctttctataaaaaacaaaatagcggcaatgataccaattagacatggaagcaaaaaaaccaatccatatcccaacatcattgtataaacataatcaaatcgggtttgaagataatgttccgttgtatctgcacctgttcccgcctttgccatatatgccaaaatcaacggaaaaaataacgataatgacatcagtgcgtataataatcttttccgctttaatttccaaaattcgcatttaatcagtttaagcaattccctcgcctcccgtcacacgcttgaagtaatcttcaagactttcttcacaggtatgcgcctccgatacctccaatccgttttctacaaaggcagttacaattttccccacaggcagatcaaggttgtgcagacgcagattgtggtcgtcctgtatagagaaatgattttcatggaaattgcgttccaaaattcttgccgcctgtgcagtatcagagagcgtaaaccggatatgcttactgcttttttgctccagctcagcaaggctttcttcttccagcaatgctccgtggtcgataattccaatatcgtcagccagcaaggaaatctccgaaagaatgtgactggaaatcaaaatggtttttcctcttgcgtcgcaaagctcccgaataaaggagcgtacttctgcaatgccgatgggatcaagcccgttgatcggctcatccaaaatcaaaagctctgggtcgtgcataacggcaagggcgatggcaagccgctgcttcataccaagagaatactgtgaaaagagctttttatctttgtagggcagtcctaccaaatccagagcgtctttgatggcatgattgtttggtacgccccgcagagtagcaaagatacgcaagttctctgtgccggtcagatttggataaaaaccgggggactcaatcaagctgccgatacggggcagcaatttcttttcattcccctgcaagggttttccccagattttgacctccccggaagtcggatttgttaagcccaacagcattttcatggtagtagtttttccagctccgtttctgcccagcagaccataaattctcccacgcttcacatggatatttaagtcagccacactcttttgtgaaccgtattgcttcgtcagatttttcgtttcaatgatgtaatttgtgtccatattcaaaacctcctgttctgtaaagtattctatcacgccaaccttgtattaaccttgccgcaaccttgcattaaccttgcaatttgaaatccggcaaaatgacaaaggttcccgccataaagacgggaacccgcttaaatctccaaaggaaaaagcaacataaattcagttccttttcccggcaaactttcaactgttatgcttccacccattttttctacaagctgatggacaatagaaagaccaagaccgctgcctttttcagaccgacctttatcacacttataaagccgttcaaaaatgtgtttcaaatcttctttctcaattcctacaccattatccgccagcagcagcttcatgttatttccctgctttgacagggcaattttaattttgtctgcatggctgtgagcgattacattttgaatgagattattgataatcctcatatagctgtccgtatccaatcttacccggacaggctgttcgagaatatcaatgtcataatcgacctgcttatcttcaaaaatcggtatccagtcgatcaggatatttcttgtcagctctgcggcctcaataggatggatttccaaagcaaactcgttggaatttaacttgaaccagtcaaagagtacatcaatatattctttcaaatcatgggctttccggcgggcggtttcgatataatcatctctgtcttttcctgtgaccagtcctttgtgtgcagcgtcaagatacccaatcagcgtggtaaggggcgtccgcacatcatgtgaaaggctcgtcataagctggcggttggtttcttctgtctgtcgtacagctgaaagtttgctttcataggctacaacaatctcattgatctcataggcaagaggtgctgcaagttcatttgttgcagacagaatacgccggttgccatttccgtttttcacatcaaccagtgcgtcggtcatttctgcgatttgtttttttacgcgccgaatgagaacgatggaagtcaacacagccacaacagcaatcacaatggacaaaaaaaagatgatctccatactggctacacctccttattaaagcggtaaccaatccctttgaccgtttggatatacttcggacttgaaggattgacttctagttttttacgaagccggctgatgatcgccataatgttactgtcatcatagaaatattcttcgccccaaacttcctcataaatctgctgttttgtcaaaatttttccttgatgctttgcacagtacaggagcagatcaaattcctttggtggaagttcaaaagtgccattttccgtcgtaacagaacgattttcaaggtcaatttgcaatccatcaaaatccagtttttgcatggctccagcctgctgattaaagcgagtatagcggcgaatgagggacgcaatacgggcaatcagttcgtccatgtcaaacggctttgtcagataatcgtccgctccggcccgtaagccccgcactttagaagcgctgtcatttttggatgtgaacatcaaaatcggcaggctgttctctttgcggatttcttccagcgtttcaaagccatccataccgggcatcatcacatccagcaccacaagctggtattcctgctcttttaatttctgcaagccctcttttccggtattacaaaaatcggcttctatatgttctgattgtacgctgtgtttaatcaaagcgcacagttctctgtcatcatctataatcaaaattttattcatggcgcaattctctcccttgttttgtccggccatcaatcggcttttctgcagttttaggaatcagccaaataccggccatctttactgctccagaaatacgttcaccagcacaataataatttaccctacgaggcgtcacgccccatttttcggcggcctcttttagtgtcatatattccatatcgcacctccatagaatctattatagttctttagctcgaacaatacaaccttcaatattaagcgtttggaagtggacattaaaaaattaaagccacaagatagaaaatctcgtggctttagcttacaagtgttcaaatttatagccgattccggagacactctcaatatagtttggaagatctggttcatatcgcaatttcttacgcagtttacttatatgattatgaatggcttttctcgaatagaaatcacaatcctctttccaaaccaaatcggtaatcagttcataagtaaaaacacgtttgggattggcaatgagcaatgccagtatatcaaactctttacttgtcaggttgataatccgttcacgaactctgacagtacggtgttccaggcatagataaagctcgccttcttgtatttctgtaagaggattcttctctgcagcaaaggaagtgtgacaggaattgaataccgttccatgacagactccttgttccaaaatatattgcattagagcattcttttgtttctcgttaagaagcagaaacaacttttctccaatttgcttgccggattcttctatatcaaaaacagctaatgtcccatcacatcatcacctccgtaaaatttttcaattactccacaaagaacagaacccgtcggatcagctccgggatattgaccggggccgtgatatagtcgttcacgccctcatgccggtattcatattccgtggcaaggtcgttgttctcggtgaggataaagaacggcagaagccggacagggggattcttcatttggaacatccccgccacccgccgcagcgcatgaaacagctccattgctgtgccgtccggcagttccagatcacacaagatcagttcaatttccttatcctcaaaaatccggcgcttggcctctccaatcgaggaaaccagaatcaggtcaaagcccttttgcagcatagccgcccgcagcacttcggcgctggtatcttctgcatggacaaagagcagcttgtgaaaagtcggggccttttcgccggataactgccggtaggcgtattccaccagcttatcttgcagcagcagccctttcattttgtccatgcacagcgtagcgccccggcgcatagcctcttgttcgtagtcgtccctgtcatggcaggacgccagaataaaaggcagctccttatctgcggcccgcacctcgtccagaaagtccatgccggaaccatccggcagatcgagatcacagcagaccaccagcggcatttcctcttggatggcggccagcgcttctttcagcgtacaagccgtttttaccgggtagccccggtgttgtaagtatttttgcaggcaccatgtataggtgtcgctgtcgtcgatcagcagtatctttttcatgtgtcctcacccccaatattgatttaccacaagcataaactacaaatgttacacaaatgtccgaggtgcctttgatttcgacagaaaaacaggctgaattgttacaaagctcggacatttcaaaaatttctttggaaaatggcgaaaaaggcggggcagcacacgccgccccgccgatctcaaaagttcattccattgctcgcatttcttccacaagcgattgatttttctgtctgcgcattgtccagaaggacagaataacctctaagccaaacagcaccagaacaaacagacccatttgcaggaaggggaaggaatatggcataatcactccatcgaaagtcatttcactgaattttcgcgcagctaacactgcaatcgggaggccgactgccagagttgccagcgcagcagaaaacgcatagcaaatcccctcatagatagtcatttggcagagctgctttctagtcagaccgatggcgcgaaagacactgttttccctctttctggacatctggttggagagggtggtgttgatgaggttgaccacgccaaagaggaataccagccacgacaacgcctgaaatcctccaaaaacgaccctgttttccatttcctcataatccttatgtatcccaatggtatccagttcaaggtcgggattggaagaaatgatcgcactcagattgttttcaatctgctccgccttttggggatcgctgacaatgctccaggaataatcaaaacaatcgatcataggcagtgcttcctgaaataactctttggttgcaaccatgcaggtgttgtccaatgccagagtgccatgaccatttttcagcttattgtccgtgaacagacctgaaacagtgacaggaatcacctgctcccctatggaaagttctataatcgatcctacatctacaccaatcatatcttctgcatagtccatatcaagtgcaatactatgggaatcctgcggtagagtccccgacacaagtgccgcttgcatttggtccctatttcgatcactcaacagatcgcacattccgccagaagaactttcctcattttcaaaccgcacatggattgcctgccggctctctatcacatctgttacgccgtctacggccagcacctcctgccgaagcgcttcattcaaaggatttcctttcgacatcacctcatattctgttttttcagaattgatatagattttataatccccatccgggaaaaactgtcttgcgatccgctctggcgaacgaaccaaaagaatagacgctgtcaccaaaaggatcaccccgcccagactcagggaagccacaatactgatcgtctttttgcggtcacgcctgaaatttgcaattcccatggagagaggatttaaccgcatattcttcttatgcgcatgggactttccgctctgattgccagtaaaacgaactgcttcaataggagagatacctgcggcaatctttaccggtttgcggattgcaatggataccataaaccagctaagcagtgcagtcaaaacaatcgcggcagcataaaatgacagattgaatccacgggaaaacagcgcaaacccgactgcacatcccagcaaaataccgattccaatgccagcccatcctaagaaacagccttcttttttgacaatacggcggatctgctttggcgttgtgccgatagtccgcagttgtccatagctttggattttgtcattgatagagatttggaagatactttgtatcacaacataccctccgatgatgaccagaactgcgattccagcaaccagcgcaagcatactgacattcacaggctgcttatagaatttcatatagctgaggttcatgatcggcatttccagctgatattccttggcaatctcccggctgcgggcagtcagctctgtttcatccatttgctgctcattcttaaaatgtacataggcacgataatcagcgggatcatagccgctccatcctttcagggcttctttggaaagaaggatggaagatccatttacctctttttctttatagccttccagaatgccagttaccgtatattctccgtgaaaactctcgctgttcagcataaccttttcaccaatcccggcatctgcaccgtagttggaaaggaaataacggctcaccgccacctcatcctccttttggggcagacggccctccagcagcttcatttggtcacgggcaatatacatcgtttcctcatcacaataaatgtaggaggcgttatatccctgcttggcaggttccacagccagcatataatactctcctacccttgagaagtcatccagccccttcagggtggacacatcttcttcggtaatcctggtatagaccgcctcataggtatcctccacatgatttttctctatctgccgggtagacaaagccatcacaatcgaaaaacaaatcagacaggatgccagcgcaacagcgatcaccaccatcagattccggcgcttctcgctttgcaaacttttctttgccagcttctttgtaatggcgctggtatcattctcaaaaggccatgtcatagcctgccacctccttactccacaatcttgccgtcctcaatgcggacaatccgatctgcaagacgggctatgtcgtcattgtgggtaatcatcacaacagtttgccggaactctgcactggtgcgcttgataagccccagcacctcggcgctggtcttgctgtcaaggttgccggtcggctcgtcggccagcacaatagccggtttggtaatcaaggcgcgggcaatcgccacacgctgctgctggccgccggaaagattattcggcatatttttcagtttatcttccagccccagcaggtgaacgatctcgtccaaaaacttctgatccaccgtgtccccgtccagctccaccggcaggacgatgttctcatgcacattcaggataggaacaaggttatagttctggaagataaaaccgatgttgcggcggcggaagatggtaagctgttcgtcgttcattttcgacagctctttgtcccggacaatcacggttccgctggtgggagtgtccagcccgcccatcatgtgaagcagggtggacttgccgctgccagaggttcccacaacagccacaaactcgccgtcctccacggagaagttcacgccgtcaagggcgcgggtgatgttcggctctgtaccgtaatactttttcagatcaatcgtctgcaaaatgctcataaaattcaatcctttctttgtttgttgtaaatgcggaacgctgctgcgccggtggccgccaactgtaccagaatcagcacagcgaacaggccgaagctctcatagtagaacagttcatcccaaaacaggggaacatcacagagagcagtcaaggcaaccgtccagcggatgtgccgggccagccattgccggaacaccagcacaagggcaacgggcgggacgatcagcagcgccagattcaaaatcaaggtcggggtcagttccattgcgtcgcctcctcacttttgttgatttataaattgaaattatatatacctgaaagccgattaacagaatcagcgtaatactttggggaggacagaagcaactgtcctcctgttgggaagtgttcagccttattcaaggacttgagggttttctacataagagcgaactactgtaccacaatttttgcaaattacatgaatcaaattttcgcctttaagtgtcaaggctttatttggttgaacttttgcataagtggattgaatcccctcaacaacatctttgccaccacaccacggacaaacatactgtttctgctcattcatagaacgcgcctcctttcttgttgataaggctattgtaaaacccaaatgtccgcgaaatgttacagcggccaaaaaatttcattgaaaatcggggtgaaatgttacaatgctcggacatttcaaaaattcttatgacaattcccgtatttgatctaccagagattgtttttttatctgccgaattgccaaatacgagaaaagcatttggacggcaagcatcagtataaaataactgaacatttcaactgtcggaaaatgatagcttacttttccaaaaatactcattgcactaaagacggtgcagagaagatacccgataagggttccgcatgatatagaaagaagcagcacccctaatgtatagaacaaaccctctatcaataacatttttgaaagctgtttactgctcaaaccaaccgcttgcaaaacacccaattctcgcttccgggtcaagatgtttgttatcagtgtgtttagcagattgataatgccaaaaaccccgataaacatgacaaaaatgtagactggcatacgatagttcaatagtttttcgttgtatgcctctacccaatcattcaaggtactaacatagaggctggaagtcggtggaattatcttttggatttcatcttttgcggctgcccatttactgtcatctgtatctacaataaattgataattgaggttttcaataggaacgatctttgacagtatttctaaaggaataaatagcgtatcatatccgccatacgggatattagcgtccacaattcccattacttttacttccaatgtttgtccgtcaacttcaatcagaagttcgtccccaatcgctgcatcccacccaaaagtttctttccactgtgggccattttcaataataatgccattattattaagtagttcctgcaaatccgctgtaccatcaatcaaatattgttcaagcagtttttgagagcttggcgtatatgcgtctgaaacaatcggttcaatatctcccgttggcatacgaacattcaaaacggtgccttggtattcttttatttcttccacaccatctatgcccaaaatggattctctaaaatcttctgtaagcagattcgatttttggagttctgaatattgttcgctgttatgtgcctgcggcccgtaatcgcctaattcaaggcgaatttctccataaggaaaactcctacgcgccatcgctaagggatcaatggaattaaaatatgcagagcttgccatcagcaaaattccacatacccctaacgacaggatcgttaaagcggttttctttctgttcctcgcaaaattaaggaacgctaaatttttcgcggatagagaacgatgtaacacttttgtactgttggacattacatcattattgcccgccatataacggactgcttcaataggcgtaacatgagcagcaatttgggctggcttaattacagcaatcataacgcatagatacacaaacagagctgtaacagcggcaattacaaataccattaaagtgttccagccttgcgggacaaggacatatcccgctattgcaccggctaatattccaatcggaataccaattctggaaagatgaaatccctctctaaaaacgattcttttcatctgttttccagttgcccctattgtccgcagttttccatattcttttgtttttctggctatggacacatagaacagactgtaaataacaagggtacacgccaaagcgataataagactgataaatgctattacagtgatatattgactgcttctctgttcaatgagagaaaaataatatgttgaaaactgcatttgctccggctgtatttccaattctctgcacaatgttgataattcagcttgtatagcagccttagaccaaccatcagattcattcaaacggatataagcggagtatgccggttcgctgatcttgctttcaatataggactgcgacacgaatacggaataatttgaattttcgacaggcaaaataccacataaggtataatctttttctccatctcccagatttaacgatatagtatcgcctatggatttagacaatccagctctatcaagaaacgcctttgtgatagcaatttcatttgtagatttgggcaattctccctctaaatcaggatattttgctaatttcattagtgtttcatccattgaacgaacggttaatttgtagtccccataagatactaaacccaataaatgacttacacccacttgaaccctatcgtcatttactaatttcgtaatggtatcattatcgacttcattgataattgcttgataacgcccagccgcatcatttaatgattttcgctgcgaagcaaaaaaatacaaggtcgttgtcattatcaagcaggtagctaaggcaatcgtaatgataatgaggatgtttctacttttatctgcttttaagtttcgttttgccaacttttttgtaatggcacttgtatcattctcaaaaggccatgtcatagttgtatcacctccatatttgataagggtattgtaaaacccaaatgtccgcgaaatgttacagcggccaaaaaatttcattgaaaatcggggtgaaatgttacaacgctcggacatttcaaaaaataaatcaggaccacccgtccaacgggtggtttgctctagggctataagcccttgttactaggccagcgtctcaaggcgctggctttctctttcggctatgagaattctgtttacacagccttcccacagctccgttcaagccatattgctcttgactcgtcgctaccccttaaggggcattgttactacttggcattaacccttaaaagggtcttcatattcttttacacttaacttatccattgcaatgtcgtgcttttcttgttcctggatatatttttttattgttgcctcatttaatccgactgtgctaacataatatccttctgcccagaaatgacgatttccaaatttatattttaagtttgcgtgtttatcgaatatcataagcgcacttttcccttttaagtatcccatgaatgatgatacgcttatctttggcggaatacttactaacatatggatatgatctggcattagatgtccttcaataatttcaacacctttataaccgcacagttgctttataatatctcttatgtcctctttgtattgattgtaaattacttttcgtctatactttggtgtgaagacgatatgatatttgcacatccatttcgtatgtgcgagtgaattttctttcttcgccataaattacctttcctttctgcaatatagcctgaacaactttattgtaaatcgaaaggtaatttttttgtataacaatcgacgcgcacccgcatagcgggtggttaaatgttgagtgaaattccatttttcggaacagcgaaaaactccatctcactcaacaggctaaagcccataaatttacggcgggcagccggaaatggccgtccgccgcgttctattttactgaaattgaaagacagcaacagttcaaagcaagctgcctttcagcccctttttgaaaactaatacggctctttctgttccccaaaatgacattgtgacaagccgatagctttgcttttccatttcttctatttttgcattgattttctctgttacattttcaacggtaatttcttctaataattctgtacgatacatcatatctttgcctccataagtttactttcattttgtaggcagcataatggaaaattccgaacccttgcccggctccgaaaccactttgatatagccgccctgccgcgttacgatctcgcgggccagatacaggccaatgcccacgccctgctgttcgtgtacttcttcctcacgatagaagcgccggaagatggcagcctgattgctttcggaaatgcccttgccggtgtcggtcactttgatctccacatacatttcccacagcaccaccgacacagcgattttcccgcctgccggggtgtacttcaccgcattgtccagcaggttaaagagggcttcggatgtccacttgctgtcatggaaaacggttaaatcctccgggcaatccacagacacggcaatttcctttttctccgctgcatacacgatcccactcatggcctgcgccacagtatcaaagaggcggcccggtttcttatccaactggatcacacccgtttccagccgggaggttttcacaagggcctgaaagagaaagtccagcttatccgtctgactgcggattccccggataaagtcggtgcgctccgcctcggtcataggcttttccagcagggtgtccgtcgccattttcagattgcttaccggcgttttcacctgatgggaaatatccgatacaagggtctgcaactcctgccgttcctcgtccacccggcggcggttctcctgcatgatctggtaaagccttgccatccggtgtccgattctggcaagctgggtttcgctgtcctccgggcgctggggcgcttcatttccggcaatcatgtggtctaaggtctggcacaggtcagcggtaaactgtgacaaccgctttccaaacgcctgcgtcagtacaaaaatccccacaagggcgcacagcagtagcgccccgcccgtcagcagcaccgcaatctgttttgtcacaagaaaaagggctatggtgatcccggacatggagaggacaagccctattgccacccggccaaacagccgctttaccgagaggttttgaaacttcattttgcctcgcctcccgtccattgatagcccatgccgtaaacggtcttgatgtagggcgcgccgccgtcggattcaatcttgctgcgaatccggctgatggaagttgtcagggtgtgttcgtctacaaacctctcgtctatatcccacagcttttccaaaagctgcccacgggtcagcacttgccggggatttttacggaacaggttcagcattttgtactccatcggggatagggtcaggggcttgccatttaaggaagccgtctgctccgagaagtccagaaacagccgcccgtcgtcgtaaatgtccttggccggtttgtggtgttccagcatggcgaacatagctttgattttccgctgcaaggccccgatcacaaagggctttgtgatgtaatccaccgcgcccacctcatagccccgtatctggtcgctctcctgatcgttggcggtcaggaaaattacaatggtgtccgggtgctggggctttatcagcttgcacagctcaaaaccgttgccgtccggcaggttgatgtccagcagcactaaatcaaattcccgctggcggatagcttcggctgcggttctggcatttagggcagaagtcacgccgtagccgtctgcggtcaggttatagtctaacatcttattcaaaaaactgtcgtcctcgacaattaaaatctgcttcatatcctcacttccctcgtattataaagtagtagtgtttatagtccctctccaaggactgtatgctatactgttggagatactgtggattggttcttgcttcctaccactcgatggtttaagaaaggctacaaccacagtctctttgtatagttgttgatcagttagataccgcatgacggtttatttagaacgaggttacaatcgcaaggagtaccgtggctctaaacagtatcaaatatttattcaaaggagatttcttatgatttacgttggaattgatgttgcaaaagataagcacgactgctttatcaccaactcggatggtgaagtattatttaagtcttttcccatctctaacaatcgtgaaggttttgaaaccttatttcagagaattcaatcggtatcagatgatttaagcaaagtaaaagtaggactggaagccaccggacactacagttacaatcttctgggatttcttcttgagaaaggtctgaccacctttgttatcaatccgcttcacacaaacctttacagaaaaagtctcagccttagaaagacgaaaacggataaagttgattcccgtaccattgccaccatgatgatgtctgacatgaacttaaagtcctactcagatacatcttaccacaatgagcaactaaagtcactcacccgttatcgttttgataaggtcaaagaacgggcaaagctgaaaagttcagtttcaaggcttatctgcattcttttcccagaactagaaaaactcgttcctacgcttcatatggcatccgtctatgctttgctctctgaattcccaagtgcagatgctgttgcaaatgcgcatcttacaaggctttccaacctgctctctgagagttcgaaaggcagatacgggaaagatactgctgttatgtttcgtgacgctgcaagaagctccatcggttctcatatgcctgccaaatctctggaactaaaacacaccattaaactcattcaggaattaacggctgagattgatgaaatcgaagccgtcatcaaacagatcatggatgaagaaatccagtcaccgattcttaccattcctggtatcagttaccggatgggtgccatgattattgctgagattggagatttctgccgttttgattccgcagataagattcttgcatatgcaggaatgtctccctccacttaccaatcgggacagttggataactgctattcccatatggagaaacgaggttccagatacctccggtatgccctttataatgccacaaaatatgtctgccactgggacgaatcctttcgtgtatatctgaaaaagaaacgttcagaaggcaagcattataatgttgcattatctcatgccaccaagaaacttgtacgtttgatttttgcaatggagaaatccggaagagcgtatctgccaatagcttaattcttttctgtaaatatctccttttagagtgccagcaatggcactctgcttgtcatgcagttttcaaggttcaaatatatctgaaatgcatttctgcaattcattcaaaaaactttcattttagacttgacttttaatagttagtctttcttttttagttttttataaataattcctggaaaaataatgctgaacaataataaaagtaccatcaacgcaatcatttcttttaccggatagcggaaagcgaaataggaaatctgcattttcatataccactgcatgataccaatccctaaatttccaaaactcataagcaatccacataacagtaaccaatagaaaagaccctctgttacaaacattcgatattcttgtttttttgtcatccctacacgttccaggattttacactcccattgccgaagcataatatccgatattcttgtatttgcgaaattcataattcctataaatattaaaattccactaatactcataagcagccatctacttgtctgaatatagttctgctcctttagcagacgttctgatttagaatctaaataaaacaagttcaatttatcagcgtgtccatattttgattgaaattccatattataattgcgaatcatctgattcagtctttctcggataactgactcctgatttttgtcaacattaaattgtatttcaaaaatttgtggtgttaatttttctaccagccaatcatatgtagtctctgttaccaataggatatttatatttttaccatcccagcacaatttcatctctgggaaatcatcctctgttatatccagataaccacaatttactaatttctcaggaactaaactgctcatttccgtaccaaccggaaccagatcataaaattccatctctgttcctatataatcctgcacttctcctgctatataatctgacatcctatgatcatgtagcacgattgttccatgattattttgaaactgctcccaatttactagcttatcatttttctgaataaagtcttttagttcttcctgctccccgatactgactgtctgaattaccgtggatattttatctccattgattagaatctttatattctccttgccattttttccgacgatcggataaaatcctttaatgttttctactgaatgaagttcgtttcctatggtcgtttcaatatcattcataagggacttcggaaaaaacttcatattctttgtgtccggtgatgattcaattaaataattgcaagcttcctctgtaattcctatttggaagtccggctctttactataataattctgtaaatccactccattcacaattaccgcagaacataatgccaattcgcacccaagccataatgacaaacttgttatcccaaatgtttttttattccgaaataaatatttctttgcaagataaatttcaggatgttttccccaacagcggaatttctttatcttcggtttcttcctgcttttatgataagtgaccgcctccgtatatttcatacactccaacggacttaatttcctcatttttcttttcagacattccactgccactcccaacgtgaaaatcacaagaacaatcgctaggataagaagtttgggttgaaagaaaaccattctttctaatttccatgtattctctgcatacattttttctaataacaatggcataataccccatataaacattccccctaaaactgctccagcgatacttcccgtaagtcctatttttagcatctcacgattcataactttaatattctgcttttgttccacaccaattacttgtaaaagaccataacgttgtaaatctttttccagcgaaatatttaggatattgtaaataaacaaaaacatagaaagtaaaaccataaccgaaaaaaagactgcaaatccataacttcccatcatttcacttattgtccgatattctgctgggttcatacttacaattctctgtccctcattcaactttatgttatttgtcagcatatgttctatttgcgaaccactggaatatttctttgtatgatctattaaaatcctacatggctcccattgaagcccgttcttctccattgatttctctgataaaaaagccacagaagcaccggaagtttgattttgatactctgtaaaatacccagaaagtaaaaagttctgcataccggttccactggtattgaaaatgtcattccaataaaaatccagttcaatttccatacccacttcgggattcttgattccaagatattgcagagttttcgtagaaagcataatttcattttctttttctggataattccctaccacatttgtaaatgcaggacgtatcattttttcaaatccggtcacatctgtaatgacgcaatcacaatattttatggaatcatctaataattttcctgcaaacttttctttcccaatgctttctatgcatggtagctgtgtaagctgttgtgtcatatccgctgtaccattttcaatataggtcgatacagccataccatcggctttcatatttttctgaatatcaatctccatcttcccatagattaaagagaacacactaaaaatcacgcctacagtaattgtaattacgataaacagtagacgatttctgttttgattctttttcctggaagcatccataagcactctttcagccgactgattacaatcgtaattctccatcctatacaaccctcccatctttcatctgaataatccgatctgccatagctgctattctttcatcatgtgtaacgataatcattgtctggctatattttttacacatctttttcaaaaatttcataacggatatactggttgtagaatctaaatttcctgtcaactcgtctcccaaaagtatggtaggatgtgtataaatagctctggcgattgcgacccgctgctgttgtccaccagataaagtcataggattttgtaatagtttttcctcaatttccagttcttcagatatccgcattacttcttttttactgatatttctttccataagtttggcaggtaaaactatattttcaaatacattcatctctgggattaaattaaaattttgaaaaataaacccaatatgccatcttctgaaggaactcctttcctccatagataactgtgtaatatctacatcattgatatagacacatccgtgtgtgggattttccaaaccacctagtaaattgagcaacgtggtctttccgcaacctgaacttcccataatagctacaaattcattttcttcaactgtgaaagatatatcatcaactgctcttaaatagtgttctccattagaatattcttttgttaaagatactgtctttactgctgccatatcaatcccccttatctttttcagatagtataacaggcaaatgtccgcgaaatgttacaacgagcaaaaaaatttatttttttcattcatttctctgttatagtagctcaaaataatgattttattataggcagttatcaaaggtttctcaatgcggcaactgtaaacagattctctgccaaagactcttaaaactactggcaagcaatgcaatcttacgtaagattgcgtatttagcagaaatcccgttcccggaattcctgctaaatgcttgttggtgacatatccccaaacccctgaaatcattgccggtggcaatggctgcgcattccgttggaacgctgaaagcgaaaagcagacaaaccttattgacgggatttttctgtgctgcgctgcggttgtggcggggaagaaatctccaatagatattccacattggcccgaacattatgaagttctttcatatcatttttggcctgcttataggcagaataggctttccgtttttgttccagaaggtcggtgtattcctcccggagagatttgacagaggggagctttttgattcccaactcgtcaaaatgattctttgccgcctggtgcaacaaaatttcagcctcatgtgctgttcggaattttttgctgtacccggctttgcgatattctacatagacagccctcgttttcgcatagtttacgatctgcttttgcagctcggcattggcattcattcttgactccaaatctttaatctgaacggataaggtattgaaattagtggtagcggcgttggctttttccagaagatcctcataacccatatcgccatgttcttttaagtagagcactgcctgagaaagctgttttaagttgaacacttttgcccaacgctcataaccgggacctttgccggaacggatcgcagcttcaatatcaaccagcaatccaactttggaaaccggtttttttgaagaagcatggcggaattttactgtccgtgtaccagcaatccgttctttgatggcctgttctgtataatcgcctttgagcgtatcacatcgggtataattttcctgtcccggaattcggaagcgaaaatgttttctttcacggttaacttcaatcccggcagcttccagcttctttagaagttcctcaaaatcttttggcttttcctctaatgcagcatcaatagcaatgcgtatctgttcctgaaaggatggctgctttttatttcccagccatgtgccataatgctcccggctgggtttcggattttctacaatcgaaagtccatgctctaaacacagcttgtcattcattcgccggattgcccaggtagagccccagaagttgcgaaattttttctgacagtccagtgtagtagagttgataatgatgtgattatggacatggtgcttatctacatgggtgcagacgacaaaggcatggtttccttttgtgagcttcagcgccagctccctgccgatctgattggcttcttccggcgtaacttcgccgggcttaaatgcctgacggagatggtaggcgatcacatcgtccgcaccctggtttctgccggtcagatttgcatactgtcgtttggaaagaagaaactctgcatcagcaagccgggtatcacactcatagccataaatgaattttccaaaatcggttttctgcggattttctacataatcaataatatctgcaatcgcagtagagatattccgaccttttcctacatgcagaggcatcagtcttgtggtcgctattttcgtcaccccccttaacttaattccaatcaaagaagttataattgcagaaaaagagcggggcttcctatgcgccccgccaaatctgcttaaccaaatataaaatcctttaaggcactgtttgccccaccaatgattcctaccagccatgcagccgccagaggcagaccgtatggactgataagaaaggcgatcataagccatgcaagacccggcaaaaatcctgcgacaaagaacagcaccaatgccgccagaaagatgatcccggaaagaatcccaagtaccgcaccggaaagaaccactaaaaatttacataccagataaagaatccccgtaaccagcataaagggaagtgccagtaatttacctatcaaacgcatacgctttgcctcctttcagaagggcatctgcccttataaaaattttaccgtgacggcaaaaagaaagcaacggctttccggctgtttatgaaatgtttgcaaatcccctgatcagtttatccatgccatcttaaaggctatttaaacaatcgaaaaaaaagtgttatagataaaattggcttattatattctatatttccgatttttccatctattttctttagtaattcttttacaatatacaatcccaaaccggaaccacctttggtgcgtgatttatcaacggtgtaaaacttgctgaataataaatttatatccatctcatcaagggattgcgttgaatttttaatcatgaacacgccttcctggttaatggacacttcaatatagttatcagaataacggattgcatttgtaattagattttcaataatacgtttacaaataaggttattgccatatatccacaccggagatttttctgtttgaataatcggctggatttccccaaattcataatacttttcaattaagcaatctgtaacaattctatttatatcaaccttctcacattcaacatcaaactgctcattttccaccacagataaatcataaaattcttgcaccagatctgtgagataatctgtttttgctttaatgatttcaatatattggtcttgctcctgtttatcttcacattcttgtaaaagtgttagataaccctgtatagatgttaatggggttcttagatcatggcttatattagatatagattgctttaactgatcttcttcttgcttaatttgaacttgcagtttcttatgcagggtatctttttgattgatcgcataagctaactcttcaatatctctatttgataaagatactcttatttttcgtttttcctttatctgcttatttatattgcgaattgttctagtaatagaaaaaagggaacatgctaatatgaatatagaacatatcaataaaaaatagaacatatccgcatttcccctttctgttgtaattagtgtatttcttgttttctcaatatcaatgctgacaccaggaatgtaataattacagttcctacaaaataaagtaagatattgatttccaaatgatttaccatattataagaacacgtattcatccaataatacatcggattgatttttaagtacgttagaactcgccacgattgagcagacatattatcccatgtcatcatataaataagaggtccgctaaaagtaaataatgacatagttcctaccacaatagctgtatgcttaaatatcacacacagcatgagtgtaataccgataaaggctcccataaccatgcaatttagccctgcaattttcaacattggaagtaattgtatcggcacattgtattttgtacattcaattataaatgcaaccataataaatgaaaaatataaaatgatgctggtaacagtaatcacgatatactttgcaataaagaattttagtcggctttgtccacttgcaatcgcaattttaatcgttgaatctgtatattctctggaaaagaaaacaacagaaaatataagaacaatcagccagaaaaataccgtataagacgtggcagtccttataatttcttcaatcattggatgtacctgatcactatatgcacgagcaagaaatcctacggtttctcctatcttccatgtttcatctacgctggaactagatactacaaattgttgctgacctcctatggaaaagataccaaaaacagctaaaatcaatgcaaatgttagatataacgcctttgtatgaaataatttataaaattctgcccgtatttgattatacattttttctaccccctattagattttcaaagtatgtttccaaatcttctccctgaacagagatttcatcaatgatgatttcattgtcggttagtaatttggaaatcattcttacattatctaaacaatcataaatccgaatagaattgtctggataaacggaatagtttttaatattagctttttgttctaatatgagagtggttttctgtatattatctgttttcaaacaaatataccgtttacattcttcattcaatttttcagcagaaatttgttttaaaagttctcccttatgaagaaagccataacaagtggcgagctggtgcaattcgcttaatatatggctggatattaaaatggtggtttcccgttctttcactaattttttaagaagttcccgtaattcgataattcccgtaggatcaagtccattgacaggttcatccaatattaaaaattctggctcacctaataatgcaacgcccagtgcaagccgctgtttcatccctaatgaaaaattcgctactctttttttacctgcgttcgataagccaatcaattctaaagtatcagcaatgcagcttttattcggaatacctctctgtattctttgcacttccagattttgtgaagcagtcatatctttatatagtgccggcatttcaatcgtacacccgatttttaatcgttcatattgcagattatcattatgcccaaatagaataatttctccttcacttttaaaattaagacctgtcaataatctgattagcgttgtttttcctgctccattttcgcccacaagtccatatatttcgccttttggaatagttaagtttacattttttaaagcatagaaatctttatattttttgctcaggttttttgtttcgcatataaattttgtcatcctaaacaactcctttccatgccactatatatgataactctaaagaaaatctaaagattatttcattttatatccaatcccccaaatagtttgtatataatcttcatttgtaattgatttaattttcttacgaatatgactaatatgagtattgattgtatcgtcatcatacgcataaggttcattccaaatggattcatataaattttgttttgaaaatattttctgtgggtattgcaatagcaattctaaaatgctcaattctgttgatgtaaatggtactaatactccgtttatataaaccaaagagttattgatctttatatttttgtatatcaaagtattattattttgataaggattatcgacagtccgttttaaatttgcctcaatacgtgcaagaagctcatacaaatcaaatggttttgtcatgtagtcatctgcccctatttttaataattctattttggtctgaaccattgtttttgctgatacaacaataacaggagcgtttgtaaattttcgcaatttctgtaatacatcatccccattcagccctggcaacataatgtcaagtattatcaagtccggaacaaaagatttgcacaaatttattccttctataccatttaaagcatattgaacactatatttattattttccaagaattttttaatcatattgcaaatatctatatcatcttcaataataacaattttacacatttttatttacctccatgccaaattattttatcataggaacttatcgttatccacataataatatcgtcgataaaaaactgttaagaataaatgaacccatatcaagatgccatttcaaaattagtttaatattatgaaagatttgcaaatccccggatcagtttgtccatgccatcccaaaggctgtccagacgggtgcggatgtcatctatatctgcggcataaatattgccggtctcattggcccgtctggtatattggtttaagttattggaacaaatgcggagaagccggatcatttcctgaatatctcccatatcaaggtgaatgatgtaaccgtctacggccatctttcgcagatatgccgacaggttggtaatgccaagttccgccatgcgttcttttaccagttcggcctccggttcggacatgacaaattcgacgcggacggattttttgttatgcccgcccttcatcgttccaaccctcttttatgagatgagacctcctgtgttgaaaccaccgtctttgctcttttgagtttttcccgcagggtggtcttttccagcttatcaagatattcctccagatttccggctgtcgcatgatagctgcgtttgaagcgttcccgttttagaatcatcatcagctccggctcattttccggcagataagtcattgttttaggggctccatgctctggcataaaccggttcataagctgtctccgttcctgatagggaatcgtgataacatttccatccgcaaatgcaacggctacatttccgattggacaggtcagctttttcatccgttccacatgttctctataatttagcggatagagattgccaaatatttttccgtccctgacttctttcaaagagatggcataagccaaaacgggatcatttgtctgttcctggtaaaaccgccacactttattttcatggcttccatccagataaacttcccgttcgcgcagggtataggttccgcaagggcgtgacatccaaagaagctgtttatcctctgaacggtctgacacagccagttttgaaatcagttccttatccaggtcaaagtcctctttataatgttgggtatgaagatctacgatacgggaaagagcacccaaaagatctacatcctcaaatcttaccccggccatcagcgttccctttccggcacaggagggatcatctgccttgcttcatgctccggtttgtctgctttcaaacggtccatcaaagacggctttgcttccggcaccagctcccggatttcttcatccgtctgtccgtctgtcagatccgggcgcacaggaggttcgttgttcagcctgccatccagcatattgtagttcccggtttgtccttcctcataaagttccgcattgcgaagataactttccggcgcctgaaacggctgtccggcaaacagaatttctctttgggtggtaaactgtgcaaggaccccattttgcagtctcgcaaattcttcatactggcgcaaggtaagccctcgttccaacatttccgtctgggtatgcgcccagccttctccataaagaaaataatacatatcgggctgatcacagacaaaacacagggaaccgtcctgattgtcatagtaagatggctgcatatcctggtaatggcaacgttcctcacggcccaaatacacacggttgtccgcacccagcatagcgaccatacccgcgtaattactatggaccgcagagcggatttctaccagcggatctgtttgagaagggatctgtctgcccggaatctcgttttgtttttccgctgcatcatttcttggtattacttcttcatggctgcgcgcatccagttccggttgagatgttcctttccgaacagcgccgggttccggttctttttctttcacatagtatcggacatttgctgtcgtatgctcgttggcttcctttgcatagttttcagcgtcggctttgctatcaaactccaacggttttccattttccttgcaccagctttgtgccggtccgaaaatagaagtgctgcttcgtactgcccatacaccataggtccgtttcctttccatttcgcatccctccttatcgttcctgctgtttggaagtttgttgcttttttactgggtctgccggttttgttgcctttagctgctgacggagagaattcttatgctccggttcggaatctgtgatgttgacatattcgccaatgatacagagcgcttctccataactgccggaagcaaatacccggtcagacatttcttttgcctgttcttttagaccatgctcccgcaaagtacgggaagcaataccaagcagattaaaaatgttcccatctgctccgatcagagggcagtccggtttatctgccaatggttccggtgtttctataaatccgcctaaataattcggcacaaagtccgacagccatgtgccgccatagacttcatgggtctgtaaacgccacagggcaagtttccctatatccagtttcacatcatcaaaagggtaaagcagacaggtcagttctccgtgctgaaaagcaaacacattttcaaactggctgccatctttcaatatgcctgcatttgtcagcatttcgttgatcccgtccacccattctgtcagatctccgccgcagccctgtaaaatcagtccttccttatccggcatacggcgaagatcctctgcagtaatcgtgttgatattcaaaaaatcgcctcctatcgtttttgttaaaatataagttttgtccgcaacttaacctcatttcaaagcaccggagtattcttatacagctcccttaaaaacagatgcgaatagccattgaaaatcaaggacttttggggctaagttgcggacatatcatggttggttttgccgctgccggcgtttgcgtttccgctcggatttccgtcttgcatagacccggcaggcatcggagcaatatgcctggctggttataggaagatatgattttccacacacagagcatattttctgtctcatggaggtgtcctcgccggtaatggctgattccagtgctgcatccaccggcaacaccgctttttcaaagtaccggcaataagcaccggtctaccatttattcagcatgtagcaagggctgtccaggggaaggcagatcttatcctgagagtcatagttggcgcaaagctctgtaaccagctttcggattgcagactgctccgagcgttttaattccctctctgccataatgcctacctttccgggtcactgctttgtctgccgccggaaattccggttgcatcagtaacattcctggactgtgaaagggcatcggcgatagagttccgctttttctgttttggttcatggtaaataaaaagttcgttttttcccggtacatacaacaagccattttcttcgcagcggaaaatatcacattctttgtcagttgaaacagcataaaaccctctataatcaaagggtaccttttgccgctcctgataggtacacagccctaagttggggtcacttgccagccgtttcgatatggcgaaaaagtcgccttcttttttgtaaaattttcgtatgggcgtgaagtgataacctccatattcaaaggtttttcgatcaatcatttgcgcctgcctttctttacgggaaattccagcttgaaattcacatatttaccgccggtatcatccaggatcacttccgcatcataggtccttcctgttttttcactgtaaagcccggacatagaaatgcggccctctttcaaaagagccgctgccacagactttgtgatagattttttcttgctggaaaagaaacggttatctttccaaagagcaaaagaacattccctgttgccgcagaaaaaacctttctttccttcaaataccggggcaccgcagcggggacatacccccacggcttcgtgtgcagttcctttggaagaaggaaacagatccgcaaaacgttcttccggggtagtatgttcttttaccagcgtccggctcatatctgcaatctgatccataaaagatgttgccgacagttcgccatgttccacttgtttcagcatggattcccattctgcagttaagatgggagatttgatattgtccggcaggactgcgatcaggttctttcctttttccgtaggaatgagctgctttttctttcgctgtacaaatccggcagaaaccagcttttccagtgttgccgcacgggtagccggagtacccaatcctttacgctcggcatcttccggcatatcttccgcaccggcagtctccatagcggacagcagtgtgtcctctgaaagcttttgtcaagggggtgcgtggatatttttcatattacttacgcagattctctctctgcttctgcctgaataatgcgtttcaacctgtcctccgcagtcaaaccgctactatggtcaaaaaacactttgactttataatttgttttgccttgcttaatcacaaaaactccatccggtttgtttttctccgaatggttattttgggtgggtagtgtactgttcacaatatttgtcatacgatattcctccttaaatgaaaaaagcccgacaaggaaaggtctgacaacgaagttccgacaacggacatcagaaaaccttttttctttatcgggcgatactatctttttactatttcctttttctttataatattggttgtcatggttgtcagagagggaaaagtgccgcaatatcaaggctttcgggatttttacccgacaaccagaccgacaaccggctcgacaaccgaagcgacaactggcttttatttttgcttcaaccattcttccggaagccctaactgttccatttcctctgtcgggatttcttgaaaaccatccatgctgttgtcaggctcgttgtcgttcctgatacgctcccagcctttttgtctgcggtaaggctctggaaaatacctcggattgctgaacgccctccagcctgtgacagcgttattcataatgtcattgatctctcgcagttcccattgtttcggttcgtcataatcatgccccagtgcttctttgtaaagctgtttggagcagactatgctgccggaatagcgttccagataatctaaaatctgtcctgcctttgtgtcctccggcataaagtccttttggtgggctttcagataagcgttcatagccggactgaatctcagacggaaattgccgcttctgtaaatctccatagcttctgcccacatctgattgatatactctctggaagcctgttcatccgccaaaatatgaacctcagccctttcaggatagaccataaccggaacgaagcggcggttgcctgttcggtcaaggggaagaaagtcaagggtattagaagaacctccaaacacacattgtcgttttctgtctgccggatgtgtttcatagggtatcttataggtttccttttgtcggctcagaaaggacttgatttcttcaatgctcttagcgttggcagttgcaatcatttccgacatttcaataatccaatgcccctgcattttgcggtacacattttcatcatccagctttttcaaatcatcagagaaccagtcatcattgaccgcaagcaaacggaagaaagaggactttccggctccctgaccgcctacaagacagagcattacctcaaatttacaccccggcttaaaggctcgtgagatagcacccaacagaaacaacttcaatgcttcataggtgtaatcatctgtatcagaaccgagaaagcggtgcagacagaagcgtatgcgttccgttccgtcccattgcaaggcattgagaaaatcacagacagggtggtaacggttttcattggcaataaccgcaactgcgtctatgattttcttctctacggtcaatccatagttttcttcaaaatataggagcagatatttcacatccacatccgtcaatgtcgggctgtcacgataccaaccgaggggcttcacaatgtcgattctttcggtcagaagattttttcggatagcccctttcaaaagcgggtcatattgcagaacacgcttataatttgcggcagtattataaaccttacctttctcgctctgctctaagctgtttcggatttcttctactgtgcatggttctgtctgctgacagttctgcaattcgctgttcaagttttaacacctcctttctctgttctgccacaagtgcttttcgttcctccaatgaaccatacagaagaatatcaagcagatattcgatatagttcttcttatgcagtgcttctgcaaacaggggattccattcctcatccggctgtttaggagcgtatttcttttcccattctctaagaagatgaaaataatccgtcagcaccttgtagcaatgattttctcctttttgatacttctgttccggtgtcggctcacgaatacgagggcggacactgggcttttgtcggctgtcatagttaaggccaaaatcttcagcaagtttgacagcagcttccctcagcccgataccgaatagcttcgctgtgagatcaacagcgtctccggttgctccgcagccaaaacagtaatagcgttcatccagcttcatactgggggacttatctgagtgaaacggacagcacgccatacctgtgcgacccactttcaagccataggcttctgcggcttgtcgggcagtaacattttcttttacaacttcaaatacattcatgtgactcctttcctgaaacgaaaaaagcacctgtcattttcaaaacgaaaacagcaagtgccttagagttccatatttaattttaggtgcaaaaaagcaggagaccttttcagatttcctgcttagcaaagctgtgaagatttaattgtggttgggttgccagttatacaaactggaaattttctttttagaatgaattatttaatttctacaatagcaccatatttcgtatgcggaagatattgtacctttaaataagtatttttatcaatataccttgaaaatactgtgatttcgatttcatcatctttaactttatcatatagaaaaacacttcttctttcagaagatatatctgcaccaccatgagattgttcagttacatatccttctgcataactatactgtttgtttatgatgtaaggcatatctaaaacaaaatctttcaaatataagattaaaagaatagctactataacaagaatggtattagccaatcgaagaaatattatatcattttttccagtatattctttttttatcgcttctttatcaaaaaatatcgaatagataagttttctttttttaattagatagataatgcaagcaattaacgctataacaaataatgaaactcttataaacaatctaaatatagcaaaatccataatatcatccccttaaacttcaagtttgttgcttacattatacttcatcaacctaaagaatggaagattttttcttgcctcccaaagcaaaagcacctgtcattttcaaaacgaagacagcaagtgtcttagagttccacattctattttgagtgcaaaaaagcaggagaacttttcagatttcctgcttagtaaagctgtgaagatttaattgtagtcagtttttcttataccatccgaaatttatactttaatgttctctcataacaaaaatcaattttgtcctccaacaaaaataccgtttgggggattatcccatataaaattatcctcagccacttcgctctccaatgcaatttcaattttatacaaacctactgccttactatcactatcattttgactatacatatagaaattcatgtgatacttttcgcttgatgtagatatattatacattccgtcaagttcaattattttttttccgtgatcactgtcacttgaagaggcacaatctccttcaaatgtttgtatatctccttttaaatactgaaacaattcattgattttcacatcaatatttttgatattttttctactattttctgaaaatagttctttcagtttctgcgtatcctgttttctacatgcttctattatttgctccatcattttatctgcttcctcttgttctgatgtaaaccaatcagacatatatttctctctattcatacatcctcctatactaaaaattataatacaacaactaattatcgttataacctttttcataaaaatctctcctcttaccaagtatatattaccactttatttagtgtatcaaactcaaacattacaaaaaacaccaagaaaactaagtgtttaaaccatttcatcttatccgctcctttactattccatattttgaatgagggagatactcaactactaagtgttctccttgatgaatacctgtactatatactattacagatttttcctgtccagtatcatcctttattgatatacttcgctcttctagcctttcctcatcactataattccaagactctactattccttctgtaactgtatactcttgcttgactaacgtcggaatatctaatatagcaggaataactatgcaataaaccataaatatcaaacctatcccagaaataattttaataattttattaatatttttttcgtgatttcgtatccaatctctggtgtcaccaggtgcctgctcccattttataagtctaaccttcttccatatccaatataggtatattattaaaaagataactataactgtaacttttccatacaagcaaagtaaaattatttccatgagaattcctccttctacattatcggacactctatcatttcatttaatttttcctctcttagtaactccgaaagcttttgtaaatattctgtaacataagagatttctgttttttctaatggtttctctttatcttttagccttgatttagtaataggaattaatgtattcgtaacaaaatccggaaatgcagaaatagcttctaacgcaaaaaatttcttactatcattatacttcatcaacctaaagaatggaagatattttcctgctccctaaagcaaaagcacctgtcattttcaaaacgaaaatagcaagtgccttaaagttccatatcctgttttttgcttttcgccggaattgtccggctgacttcacgctctgccatttccttcttcttgcggctcaactgctctataatggaacttttggctttcttcttgatttgctccgttccggcttttttgacctccggtttcatcagcgtagtttggattttctgaatagttgatttcatagcatttgtgattctggcaatcacgccatccaatcgtttcactgcatactcaacttctttctttgaagccttacgctcaggggagagaacccacgccttagactgctccaccagcttaatatcctccttgtgcgtttccagttttacagtatcagcaacgacctcaaccgccttgtcataggcaatatcggcaacctcgtccaccaaagcttccacatcttcaatcttcatcgtgagttcttccaacttttgctcctgtgctgccagttgctccttttgcttgaaaagaatatagtcctgtttttccagatatgcacgaccaccatattccggttcttcttccagttgtaagccatgctttttcgccacatcaaacagcagcactcggcaagctgaatcgaaagtcatcttgcggttgttttttcttccgactggcttctccggttccggcagttcaaaccccaatgcttccaaagccttttcctgttgtggggcaatctctccatattgattttcacagtcgaacacatgacgctcgtgaatatgaggggtgctttcatccaagtgcagcgcccaattcaggatatggacatgagagccgaaacgctcatttacgatttccataaattctgtgacaatctcaatgagcagttccggtggaacatgattatcaagtgttccaatctgatagaccgtttcctctggacaggtctttttgcttttgagtaaatcaccggtttccttattcctttcagggtgtcggttcttcacatttctttcgttttgtccggttacaaaatcacgataccgctgacgataaaaaagctgttccacatcttcaaaagtggcagacagctcattttccttatcgggatttttgaaattgcggaagccattgtaacagtcccaatagagattttgtttggctcgttcttcgtcaatgtgttcgctgttggcaatgtcaaaactgcggtcattgtgcttcggattataaacgccattctttccagctcgtccattgtgccttgttaatttcacatgagttcctccttttctttttgatttccccgacaggggagaagggcagcgaagctgattccttgcggctttctgcgtcaagtaatacccagtactaagtggcgaaacgccacttaactgggcaaggctgccgcccttgacctgcacaggggtattgcattccctgtacccatgcacaaagggttgcaccctctgtactcccgcccgaacaaactgacttcgccccgtcccaagctctgtcagttccttcggttttacaaaacagtccaccggactattttgcaaaaagaaaaaccgacgcatgatcgctttacgctcaatacatcggtttcttcatctgaccttaacggtcatattcagttgtggcagattagacaatttgaaaaattactctggcatatctactgaataacttagattgtttcctctcttgtcgctctttaaatcatcataataccatagatacatcgttctgtcatatacattgatttcaataacaccatctggcttttgaccttctacttctaatgagtaaatttccttatcatgtgcatagccaaaaacaaatctggtatctggataatttggattcaagtcctgttgaaaatcacttaattttaaagatgaatgaattagttctgtaatatcagatataagaatgctatccgctttagttgtaaccggtgtagcattcataaacgcatattgtacagttgcttcctccacctgttttttgcagcgtgccatcacaaaaccttgaacgggatcattatcgcttcctgcccgatagaaaatcgtatcatactgtttgccattccatatatgcaatatttcatcaacatgattaagaaaatcttctggaacagaaaattcttcattttcagtattcaaaggagaattcaaaatagcttcttcgacagaactataatatatgagttcagaatcctttttatcgtaatcgctcaaattgaattcgacatatgcattgtctttattgtcatcttccggaacataagtatagcgaccattttcaatatggtcatcataatcaacaaacagtccaatacatatcagtgctgcaaaaatcaaaaagactattcctataatgattagcaatattttcaaaaattttttcatacaaaagtccaccttcttgcttcatttcagtaaattatatcataccgatatgaacaattcaatttacactctatcaagtagtttttttacttacctgtaacgcacatttctgcaaaatccatagtccccgatactttcctcacaggcgataggcaacggtcaaaacatcaggtctgcacctgacattttaaccgcatatcagccctgattatcacattatccctgctggctgttcagcccatgctttttcgcatattcgctggctttctgtctgcgttcctcactgtaaggcggcaagaaacggatagacagacgggactttgccagctcataagaaacaccgccttgaacattggatttttccagtcggcaaaggtcagggtacttcttagcaaaagcagccaacctctttttcaatccggcgttgtgggtgtagatatttgccttgtcctcgccctcattaaagagaacgattgtttctttctcaatcttcgtcagtctcgccatagcagccctccctatggtttttcaacacacgcagcttgcagtaaaagcagcgataccacctttcaacaccctcagcactcagcttgacggaaagcatataaaacagcttcttcgccactggatcgggtgcaagggcagccaccatacgcaaacgctcaacagttgctttcaggttcggacagccaaaggcataaagggcttccatttcattccggttcatcttcattgtgttttcctccttaaagtttgataaatgaaaagcgacagacacttcataaggaaatacctgtcgcttcgtttacgatataaatttgttggttttggacttgataaaatcagcagtaaatcatttcctgtctgatgatttcttcggctcggttacggatagagttcatggactgtacccacaatatctgattgtctgctttcatggtttcggtcacaccctcggcttgtttcatctgctcaatgataaggctgcacctttccgttgcctgttcgttcaggtcagcaaggtaagtatgcagttcgccggataaacagagggcagagaaccttgcagggtggtactgctctaaatatgtcctgtgcagtctgccccacataccgatagggcggtgttcctccggcagcttcaagtccggcacatagtaatcgcccacaagaacatagtccagaccgttgctttcgtcatggattcgtggtttcaattctgtcatgctattttttctcctttcactttttgccgatttgatttgcttgtggcgttctgttcagcacacagcttgctatcagaattattttcttctgctatacgctcatgctccgcaaatttttttgatttctcacgaatctttttcatatacttacgattggattctcgttttctgcgaagtcgatctgcttctttttcagcagcaatcctttcttcctctgttggttcatgctgctccacaggtacttgaaattgcccgacatagttaagatatatctccacctctgtggtgcggtctgcaccttttccctgtggctcgtgaaccagtattttatctataaattcatttatcatggcaggagtaagctctgtaatgttctcatactttttaaccagctttagaaaacgctccacattattttgaccgcctataattcgttgcatatcagcggtgtcagtctcaataatcttgtttagctcgttctgctcattttcataatcagtaagcatactctgaaaaagcctgtccggcaatcttccaattacgttatcttcatagattttcctgataagcatatccagttcgtgaactcgcttctgatttctttcaatgcgtttttttacagtttcagaaacagcaatatctttcatcgccgattcttcttgcagagaatagacaaactcctgctcattcaaagaaacataatggcaagtctcttgtatggttttcagaatgatgcttttaagtgcttttgttgaaatatggtggcaagtacaatgccggtcatacttctgataagcaagattataagtggaacattcataacaatctgccggatttgaatggcttatccgcttttcgcctttggtagtatagtatattctttcacgcccttttcgttgcctgtgattatacatcggcgcaccacagtcagcacagtaaatctttccggttagaacattaggctcacccatagggtctgcttttcttacattctgtcttaacttttgagcaagcatccatgtttcttcatcgacaataggctcttgtgtatcatcaaaaaccacccaatcttccttatctgcccttttcgtctttttgtccttataggaatttttgaatgtcctgaagttgacagtctttccgatatactctggtcgggcaatcagagtagtaacctgatttcctcgccacatatacggattttctttgtcatagttgcttgcatgatttccaagtccctttttgccaagataataagatggtctttcaattttttcttctgaaagttctcttgctatctgataaggtccttttccctcaatagtcatacgataaattctgcggactacttcagcagcttcttcatcaataatccaatggtcggggttttctgggtctttcaaatagccgtatggtgggatattacttgtatgagcgttgccggaagaacctctggatttcagtacagctttaattttcttacttgtatccctgacaaaccactcattcatgatattcagaaaaggggcaaactcactggtttcttgacggtcactgtcaataccattattgattgctataaatcgaacttccttttctctaaacagaatgtcagtgaaaaaacctacttgcagatgatctctgccaattctggacatatccttgcagatacaggcagtgatttctccgtttttaacaccttcaacaagtctgttccatgaaggtctgtcaaaagttgctccactccaaccatcatcggtaaaatgaacaagattcgtaaagccatgttttatagcataatcttcaagcatttgcttttgatgaacgatactattactctcgccagcattatcgtcatcacgagacagtctttcatacaaagcagtaatgccattgcttctatctttttttcttctcatgctgaactcctttcttcaattcctatccactccttacgctcacaaaatatcacatccgtatagtgtttcggcggtgaagttttcccttcacggagacttgctgatacagcttcaaaagtctgtccttcctgcagcacagggagagcgacagcttcattttctttgtgttccgtttcactctgcctgatactcatacggtgaatccgttccacctctttccagccggactgtaaaatagtctttccttttgccgtaaaagtatatccctggcagtccaatatagcggtgaccgcttcaaatcggtgtacctgcgttgtggcacaaagcagtctgacggcaagcagggtaagcacatcccgctccccggaaggaagctctgacaggtctgtccgtgcgatttccacagttgggataatggcatggtggtcagtcactttgctgtcatctgttacccggtcaatgtccggctctccggcgtagccttttccaaaggtcatattgtcacgcagccacaggatcagggaagcggcggttgcctgcatgtccttcgtcaaatactggctgtccgttctcggataggttaccagcttcttttcatagagagattgcacataatcaagggtctgttgagccgtatagccataaatacggttacattccctttgcagagttgtaaggtcataaaggcggggaggctgtatagtttttacctgcttttccacagaacgcacaaaagcggagttgtggtcacagtccatacggattttttcagcctcggatcgttccgtcattttttcgccggaagcagtaaaacctccgcaggtgatttccggcacataaaaaggcttactgatgaaggattcaatatccgactcacgctgtaccaaaagtgccagtgtcggtgacataacacggccgacatttagggtgacaccatacaggacagaaaaaagccgggtggcattgatcccgatcagccagtcggctcctgcccggcagaccgccgcatcatagagcttatcgtaatcactgccggggtggagatggtcaaagccctcacggatcgccgcatcctccatactggaaatccaaaggcgctccataggctttttacatccggcatattcatagaccagacggaagatcagttctccttctcgtccggcatccgtagcgcataccacggaatccacccgtttgtccttcatcaatcggcacaaaagggcaagctgcgttttcttatcctttggcacttcatatttccagttttccggtaggatcggaagatcctcataccgccatttggcgtactgttctttgtaagcctccggctgtgccagttccaaaagatgtcccacgcaccagctcaccagatagccggaaccttcgagataaccgtcttttctttccgttgcgcctaatactgctgccagtgacatagcaacagagggcttttctgcaatcacaagtttcatatttttattcctccttcatagtttcaaattctttatccgcaagttttccggtttgcataagacacatcagcataacgccggaagccattcctccggcaaagataaggaaatgtgagattaggttccacataagcattcctcctaaaaatgggtaaagaaaaacgcccacttcaaagtgagcgcatcaacaggtatctattttgtttttggtttcaagtaatccggcaggacgatctctccaaccgggatttcccgcagttccttcttcatccggtgggtgaagcggatcgtctttgccgtaccgccggtttcccgtccgtcatagacagcgatcactcggtcggagtgctccaccatatagcggtttctgtgggagtagacgcttgggagatatttttcctgtatgacaacaacatccgcacaagcctccagcagttcatgggttcttgttttcttattcaggctgtccagacgcttgcggtaagggatcactgcgatcagctccagcgccggattggtctgctttctttccaacaccagctctgcaaaatactgatccacgccatctgcaaagccactcataaaacaggtgaatccatctgtaacggcagcatcgatctcatgttccaaagcggcttttattttgttgatctcattctgcggtaaatccctgtgtccggtaacacagcaagtctttcctttcatcggtcatccctccatctgataggtaaaattcttcacttttcacatagtaatagattttatttagcaagtcaacgataataccctttttctctttgcggataataaaggggtgtaaggtacaatctattacagaatgggaggtgaaggcgatgtatgaagattttgtcccggaacgattagcgaagctgcggacacagaaaggagtttccgcacgcgatatgtctttatcgttaggtcaggcaaacaactacatcaataatattgagaataaaaagtcacttcccgctatgcagtcttttttctacatctgcgaatatctgggtgtgacaccgcaggaattctttgatgaaggaaatacctacccggaaaccttaaaggaattcattgcagaagcaagacagcttgatcctcaatccatgcaatatatcctcggtattatgaaagaactcaatagcagaaagtaagcggtcacggtaaaggccgcttttttcgtgactttctttattatattttataatgttctcgaaatgtccgctccctataccgataagtattcaaaaactgttctccaaacagcctttttctattcgccggtactgccaaagctgccggttcctcgttctgttcccagatcggttacaaaatccgcaatgacgatcggcgtgatcacaagctgcccgatacgggctcccttaaaaagagactgcgcctgattgcttacattgctgatgatcgcatggatctctcctcggtagccggaatccacaggcggcagttcacagaccagaccttttaccgccatgctggtacggggaaagatatatcccgcatatccatccggtatttccagtccaaagccaagaggaattttggcgatttctccgggctgtaaggtacagtcatagggcagataaacatccgctccggcatcattgccatgcggacggtaaggacgctggtgctccggtacgccaaagtcgatcagttttattttcatcggcagcctccttcccaaagagcaggataatctttttctaaaatatcctccggcgtcatatctgcctgcagttttcgcccgcaggtcattttaccttccagacatcgatccatctgacagaaaggcccggtcagtgacggggcaaacaaggcagggcttaggtcataaagttctttccagacctttaacagcacgatccttgtttcatctgtatttctccggcatacccgctggctgatgatatgtttccactgataaggggtagcgctgatgagcagcacatttctaagaccctggggcgtggcatagccggccgcatcgtgcccgcttccggcagagcacagggcttcataacatttcatgctttcattacagctttttaagtacaattcccgtaccactgccggagccgtcataatagaatacgggacagcgaaatccgcctgtcccgtatagttgctgtactgcagcgatgcactcataaattttacttcgttctggtggcgggtgatctgcgccagaaaacgcctgctggcgccgacaatggctaccgtgatcaccgcaaatttctggatggtaggatggggaagcgcccccatagctgctattgtctgaacgctgaatgatttttcgtagagctccatcaggtcgtccattgaggcaatcttatgtccctgctgggtaagccttgccgcaaagaccatgtttttttctgcttccgccaccgcctggcagttcaaaagttttacttcaatctgtttaattggtatgtccctcctttacaatcgctttcagtaagaacagatagttaagactgtctgtgatcttttcgtcccatgtgtccatcggataaactgtttcctcggcaaagcacatatcgtacagagaaacaatatgctttgccagcataccggcaagggcacgctggggcgttgtatgctgtaaaactgccgctgccttaaatgcacccagccggtccgggtcatccccggtgtattctttggttttccgtttcaaggtatcagcgcaaagccgtacctgttcgtcaaaaacggcattgacttcattttgcgtaatatagcatccctcctttgaaaacaagaaaccggctattctaaagcatcttagaataaccggcaaataaatggatatgtaattgttatagtgtattgatctctttttccagttcccggaccgctgctatgactgtctcaaatgtcggaacatccccatacaacatatcctgcatagagttatagtccgcttccaatgctgcaaaccgatattccggcgggagtaattttaatgtgcccggcacagcctccgggtacttcgcccatgctctgggatagaatttcattttgaaatctacaactttcttcaggaggtcaagcctggaaaaagcagcttctttgaccggtgttgcagccatgcggtagagatcataataatgtctggaataccgctgcggcatttccaaatgttccggtctgttcgcttcatggtgcaggattgtggctttttcccagaaggtccgttccggggcaacggtaaggattgcggtttctttttgctcaaaaatcttcggataatattttgccgcgtatggttcgatctgcgctgtttttgcaggagtccacgctgccagcgcaccaatctctaaacggatcacctgtaaggtcgccgtatttgtaaaaaggtgcggataggcgaaaatgaccgtctgtttatccttttcatctatgtagacatttgcttcacaaccgatttcctgggataagccggctttgactgccgggcagaatgtttcggacagaaatacttccgcacgcgcattggcttctttgttaaaagcatcctgttttgtattggaacgtttctcccatggttcatctttgccatatcccaatacacgccagtccagaatcaaatcaatatcttctgaaaaccggctgatcaggtgaaaggcttttgaaaggctggtaccacccttaaaggtgatggactctttccatagtgagcggtgaaataaataatccagcgtaaaacatacccaaaagtctttttccacgatggcatcattcagccccattttatctgctgtatttctgaacagctccctgcggtcgttatctgaaagtcttgctatatttctcattgtaccttttcacctccacaaatctgccgtatcgtatcgtaaacccaatccgtagactctgttgcttctttcaaacaagcctgtttatccttgtctgtcagtttttcggaaagcatctgtatgacttctggcgtaatattcgatctgccaagcgtttttaatgcctgtataaccaaacttgtcatataggacaatccggtaatctctttattggtccggtgcttaaattccagctttgtagagttccactcgtaggtcttatatggaccatcgctgatataggaccatactgctgttacctgtgttgaaagacctaacaggttcaatgctgtattcccacatggagcaatcgtccagtgataacttcgtgccaatgcgttcgccactgcttccgggtctgccgccacatattcatccagaagtttgctatattttggtttttcataaacaccattaagaatccggcgcaatattccatcttgaataagccgatataaagcggagcgcactgtatttgtgtctgcaatatccgcaaaatcagaagttgaaaaaacacttccttcctccgcagataaaatcctttcacgaatttcctgcatatatccttttgccactgatttgcacctcctttgcaacgaatattatatactatccgttgcattttttcaatcatctgaggctcctattttttagtgttcccaaaaaagaagcctctgatacacaataacagaagcaaaaggtatttgatttgcaacaaattttatatattttccgttgcattttaagcactcggcaggtagatccagtcgtgcatcaggcacacgctgggttcatcctccctgggaaccagacggtaggtacattccccatagaccgtgcgtttgtcctcgatctccatgccataggctttataaaagcggtattccagattggagataatacagcgcagggtttgcagagcctccctctgagctgatacaatcaggtcacggtcaatgctgcgcttcaaaaacagcagcgatttgtaaagctgtacctctgtgcggtaagggcggcaatctttcgtttccagccatccgcaaaaagcgaccggtccgctctggatcacactgcggtccgggtgataatactcatagcagtccaggtttgccgtattcagaagatagagcatttcccggacttcattttccggcatgtcgtaaaaccgcaaaagcgagcggtaaagatggacatagccgggaatggaaatcatggtatttaccataaaataaaatcctccttgtaaacagcaggtgcgggagcttttgcccccgcaccgcctaaaatctatatttcgttatctactttcacgagttttcccatgacaaggaagcgtcctgtgccgcccggcgtacaggtagaaagggtcagtaccttatcactgcaggtcacagtcacatcactttccaccgcggaacgttccttcatagctgtaagccaggtagtataagcaccgtcatccttccaggaaagctgccagggagaggtttcactgccggattcttccggctttgctgcaaacgccgcaaagatctccatgacataaccacccttcggagtaacgagatacatctgcctgtgggtatcaaagtaactttgttcatcgtaccggttcagcagagcaaacatggaaccatcccgcatattatgaccgtaaatgatcgtattgcggtctgaaaaatctgcctggttttcatagtcggcaaacaggcagccaaccttgttataggtcccgtcataaagatggttcaggtaatactcgttgttgtcggtctgcgtcaccggataattgagcaccgtatcaggaagggaaagccatccgatgatgtccggtccattttcacggagcgcttcaaagtctaccgaaggcaggataatatcggcatcgtcctgttttgtttctgtcggatcggttgcctgctccggggagtctgtctgctccggtacttctacatatccggcaagattccgataggcgtctttactctcggcatactgggtcaggtcacggaacaccaaaaatccgctgccaagagccaccagagcgcagagtgaaaggacagaagccctgacagccgttctttttggggaagtcctgctgtattttccctttttgaaataatacacagcaaatacgctgccgccgatcagtgcggctgccaacagtccgccatataggaaaatatacggattatctccggtctgcggtaccggcttttgaggagtggaaggattggacggaacagaaggcttttctggcttctccggcttttccggtttttcattaaaaaactggaccttagatgtctggtcagctttgatctccaccgtagcggcatcaggaatgatgtaatccttgcttgcccggtttgcaacttctgttacggtataaataccgacacgaaggcccttgacttcaattacgccggattttggagtggtgaatgtctcgcagtaggagccgtccgcgctcttgacctcgatggcaaaaccatctttgcgcccgtcgctggaatcctttgtgatctttaagttgccgcggtaagcctcattggtaaatccgtgcccggcttctccattttccacaactgcgacctgtccatcttctgtgatggaaaaatagtgagcgtttgggtcaggctgatagccctccggcgctttgctttcttttataaagtagccgccagccagaaggttttccgccgtatgatagcctgcatcggtttctttcagcgtaccgatcttttgatcgtcagggtcatattcctggttggcgttggaatccgcatacaggtcgaacaccgcaccgggcaggaaacgcaagaaagaattcttgtctttcttatcctccttttccacaggggaaggttcttccacagcttcggttttagttacctgcacactgccgcggattagggtgttttccacacggatctcaatatgctgtccgtctgcaccgatatatacatggtgctgttgcgggcttactgtataaaggtcaggggcagagatctccttgacgatccagtgtccgtaaggaatgttctcaaaggaaaaactgccatcttttccggtaacagcagtacgcagcgcattttcttcagtaaatttttcggtatcaggtctaaacagtcccatgagcgcaccggccagcgtgacatcttcgccgccttccgggttttccccaacttttacaccgtctacatgcccgcggagaagttcattggaaacagcctcgccttcattgacaaggatctgtaccagggcggtttcctgtccggcatattcaaagacgaccggatattcctgatccgaaaggatataggcgccgttggtcgtgcgttccttgacataatagctgccaaaaggcaggtcggaggcgaaggaagcgctgtaaccgccggattcatcagacgaaacagagaccacttccagaagtccatctgccgggatcacgctgccatctgccgccgtcaggtctgcggaagcataaagtccaaaggaaatatccttatattcctcgttcatgccaagaccgaacaggtcatcggtctccattgccttgaaaagtgtgacatccactttctgtcgttcgtcataaagacctgttgctgcctgtgtgacctccacggtctcacccacataggtcagttccacatattccggttgaggattcagcacacaaccggaaggagcctgacgttcctccagacggtaacggccaagatagagaagcccgcttttcgctgtgccgtcctcgccggtcgtaagggtttccacaaccgtatctttttctgcccgcaaagtaccgtcaccggtataaatatcttcatctgcgatcacgtcatagaccgctccgggaagcccggcagcctcatacaccggctggtacagtccgtcgttttcctggacagaagcaaatacttctccggtctttttgatggtaagctggcctttctgcggcatattgtactgcgtgaccgtcacaaccgcctcgctgccgtcaatggtaaacggtaccggctcattggaaagcacatagccataaggggcagccacctcataaagttcataatccccggcggccaaaggctccggcagcatcagccagccctcgtcagaaacatagaaggtatccagtgtttccgggttcggatagtagacggtctgggtgataaattccccagtggaaagattcttgatctgaaaaccggttccggtcacagggataatctttccggtctctgcgtcacatttttcaactttcagacgggctgtgatggtgcggttgttcaggatatagctgtaagtctttccgtcagaggaaatgaataccgtaaagtccgggacaaaggctttgccttcctcgcctgcgatctgatggaccgtataatgcccataaggaagcggtttactggaagcaaaaccatccgcatccgtggtaagaatgtcacgttcactttcctttgccgcgtcatagcttccggctgcctttaagtaaacttcaaagactgcgcctgtttccgggcgttcgatgataccggcattgggatcgtcggtattttcgccctcaggcacatccgggtccaggtcatcggtgtgcttgacaagctggatatttccgtaaataaccgtttccgtcacctggttttctgtggtattgagttccacttcatacagggaaggggatgcacccacttcataaatggtttcattcagaagatacccggtgctcggttcgatctcccggatcgtccagttatccccgcatacataatagcgggtcataaagctgccatccggcccggtagtataagtgtcgatcagttcgccatcacggaagatcccataggtcgcccctgcaagagtggcatccccctgagcatttccggtgtcagcatcactctttaccacatggacgcggaatttcttcaggatattgctgcaatgtaccgaagaagtctgcccgctttcaatggtcacgtactgtgcggaaggggtcacatagcgatccaccggcagctcttttaccagataggttcccggcaggagcttcttttcaatctgaccgttttctccggtcgtaacttcctcattgacttcatttcccaaaatgtccgtaccggagatatggaaggtgataccggaaacaatgccgtcctcactggtcttgacaagttttgcggtaccgtaagtttccgttttgatttttacaaagaaggaaaccggatcgctggcgccggtcatcatggtctggtagccgggtctgccccagatcagcatgtcgtttgccaccgggatattctttcggaattcaaacagcaccgggtccatcatcatctgcctgctggtaaaggtgtattcatttccgtttcttgtcacagaaacgcctctgcctttcaaagcctccaggtcgatcttcaagttgttggtatctgtgaccgtcagggtatagacctttttttctacatcccatttcagttccagttccggtgcttcgcttttcttagaagaagtaaaggaagggactgtggaatgggaagcgacctgtgcaagaatccagtcataggctttttctgccggtcgtccggcgatcacgctgaaatactggtcggcgtctgcgtggccgtttccgtggcggctgtacggatcgcttctaagctgctgctggtattcccagaggatgatctgggtcgccatcttatagtcatcctcgttgatcccggaaacagggagcgccgcaccgggtttccagccatagatcgcagtcagggtgatccccctccttgcctcggcaggaagcaggttcaggtattggctgttggtcccgctttccgaaacataggtgttttccgaagtatggtaaggaatcccactctccacacagtaaacctggtggctgatcccgtcagaatccgtcagcatataatgccggtaagcattgcccccggaactggtgtgtacgtcgatggttccgtctgcatggtaggcaagataggtgtaaggcgccggggcgcggtagtggttcccatcagagcctacatactggtcgcccagccaggagcttgctgtctgtccgacagacatggcaaaagcctgagccggaagaagccccaaaatgcttgccatacaaagcaaaaacgccaacagcttgcgaaagccgcggcgtctggttatgatatgttccatgaaaaaatcctcactttcataaaatctaaaaggacagccttatttgctgtccttgtcgtcaaaatcatcctcggaaagatattccggttccccgtatgcctcatccgggtcaaagccttcgccataaccgtcatcctcaaattccgcatcgtcctcggcctgctgtttcggacgcacgatttttacataataaccgatcccaccgaccgcaagtaaggcagcaaggataaacaggatcgtgccgacgctgccggtttctttcttcggcttttccggttctgccggtttttcagtttccgccggcttttcttttcctttgcagccatttaagtcatttttgcagaccggacagccggtattgacttttcctgcctcacatttttctgtgcagttgcagctttcttcctgggggatcatgctcatgctgccattgttcttttctgcaagcgccatcaggtcggactctgtgacgccgtttaagaagtagacattgttatcttcccgtttcccgtcgatcaccagataaaaaacattgccagcgtccgtagtgatggtgtaaaactgtttttccccatctgtaccgctgatgttgtcctgtaccgttccggtgccttccggggtaaatgcaccttccgggatcgcagaagtattttcctgctgtccggtactgttatctgagccggaaggggttgcagcgtttgagccggaagttttttcttccttaggcggttttgtctgtgtaccggacggactctggggtgctgccgcagcaggtttcttttcaggagccggttctttgtaatacggattatccagctttaccgcgtcagaacggtttcctgcataatcttttgcgtatatgcttacctgtttttctgttcctgcataatctttcagtgcaaccgacgctttcccgtcggtgagggagttaatacggttttcatcaacaaagaccgcctccacgccggatagatcgtcactgctttctattttcagggcatcgccctccagggaagcagtcagcgttggcggtgtggtgtctttggaaccgccggcatgagccgttacaggtaatgtgctgacacttacaagaagcgtaagcgccagcagcagggaaagttttttaagcctcatgcacatcctccttctcctgcggcaaaacagtttccgaaggggccgcctgctgtgatttcaaaaaatccgcaagctgctggggcgtcagtttgaaactgcgcgccaccgccacataatcggtattttccagctccgttttctgttcctccagcttatggagctttgcctgcatttccgcaatctttgttttggtcttttcaatttccttttccagtttttcaattttaggattcaatttattacctccaatctgttaaggcagacgcccaaatgtataaaaatgctgctgccagtagcttgtattgatgtttgcataagagatcgggtctccacagtggatcatcattccatttcctacatagatccctacatggcttgcgccgctggtattgtaggttccctggaaaaagatcaggtcgcccggttttgcatccgcacttgataccggcgtacatacacctaaaagaccgtccgcagtcagccttccgaaattccagccgacgccgcagttgttgatcacccaggacacatagccggaacagtcaaaggaagtggaagggcttgcgcctccccatacatacggatagccaagatatttttccgcctcggccatcattgcggcaaactgttcatccgcaagggcttccggtggaatgtcataatcgaagtagtttcctgtgccgcctgaaccaacttccggcaggtgccgttcgctggtatcgccggtatcggcaaaatacaggggattcaaatactggccgtcaaccaggacctctaagtgcaggtggggaccggtggaatttccggtattcccgacctttgcgatcacatccccggctttgacctcctgcccggcagaaacaaggatctgggaacagtgcccgtatttggttgtcagggtatgtccttcgtatgcctcgccttcaatggcaacacataagccataaccgccggcatttcccgcaagggtaactgttccgtcatgcccggcaaggatctctgtgccatccggcatcccgatgtccacaccggtgtgatagttcttttccccactgatgggatgtacccggtagccgtagtagctggtcacataagggagccagttggtgccaaagacatttttgacatactggcggtttccttttgtctgcagcaggatctcgcagatctctttctggtctgcgttcatccgggaaacgaccaggttttccagaggtgtgaccgtgagcttgacatttaagatgcgccattcataaggcacttcctcctgggtttcttctccggtttccgggtcaacggaagtttcggtacggtaacggatctcggtttcttctgaaaaggacagggtatattgttcctggaaaagctgccgcagcacactttccacttcatcgtaagtaaatccctgataagcagaagtcagataccccatcagcacatacgggtcatgctcgatcgcacccaggttataccggtattcgtcatagccggggcggtctgattccacccggtctatttccatttgcagatctgtttcccactcggtataggtaagctccgcctggttgatgtcctgatcgtctgcaagataggtagaagcagccagacttcccagaccaccggtcccgatattggagaatgtggaaaacagggacatgatcaggaaaattaccaaaaggagaagcaggaggacaaggcagatcacagggtgccgtttgaccgcatggacaataccgacgctgaccctctctgttgcgactgcagcatttttggcctgtttcccggcttcacgggcagccttggcatactgccttttcagtttttgtttctgccatatccgggcaatcgcatgtttttttagctccgggtggtcgctaagagcctgccggtaagcaagtcttgcgtttgcctttgctgatttttgctgtaatttcgctgcctttcggtagggggcggttttatgccggtgatatgctgtgcgaagccccgcctcgcccacaagttcagagcggtgggctgccttgatccccacattttcatcctctgcctcataaatctttttatgggcgtaaccaatggcggtatttgcacctgccttgaccggacgcaggggtacaggtccttttacatgggccttttgggatttaacctccttttcaaattttaagtgttttttggcttttccggtctctggggcggaaaccgtctccatgcacagtttcttccgggccggcagacgattttgcgcctgctctgctttttgtgcagtccgttccgccttccgtcttgtatgggtgagctttttatcctttgtctccggtggcagttcatccgcagtaaattccagcttggatgttttcggcggttcgctatccacacccttttccttttgtgctgcctgttcctccgcctgtgccgcttcctgaaaacgctgctgatatttgttcccatgctgatgtgtccggtaacgatgttcctgaccggatctgtctgtgccgctcggtggggctgatccttcggaagaaggtgcatattgtccggtatcatggtctgtcacatcatctgttacaagagaacgcctggaaacctcctgccgggaattgcttcgtccgttgtcctgtgtcggggactctgttccggcagcatccggtatctcaaagcgatccgaaaaaacatccccaacggctgcataagcatcgccctgttccagcaaggacgccggtgtttccggtgatagctgggaaaattccgtctgtacagggatgtcctgcctgtgtgtcttgccggtgacagaagaaggggtatcccgtgccctgcgcaggtcaaaatcctgttcggtctgcctggctgccggttgatcttccccgtgggaatcacgcaccggcatccgggtatctttgcgcttcctttgaaattccctgtcgtgtgccattgttctcacctccaatccattttaatttttgtctcacgctttggtccccgctacttcatccggtcttgtggtaagcacgctgtacaacagtgtgtccttcgggaagtggtccacaaaggggatgatcacatttccaaagaacaaaagcccctcgccgggaccggaatgggtcacataggaaagctggtgcggggaaattcccaactgctttgccaaaatctgacggtctccctgggcctggttgagcatatagataaagtccgagttctcaaaaatgttctcgatctcacgggaagccagaaggtccttgacgttctgcgttaaacctgatgggattccgccccatttacgaaagcgtttccagatctccacgctgaaacttcctgtctgccctttcaaaagaaggtggaattcgtcgatatagaaccaggttgttttatgtttggaacggttggccgtgacacgattccacaccgcatcctgcatgatcaaaagcccgatttcctttaaggcttttcccagtgatttaagctggaaacacagtacccggtgttgatccatttggatattggaacggtggttgaacacgttaagggaaccattgacatagatttccagcgcagttgcgatattctgtgcctccggttcagactgtttcaaaagcagctcgtaaagatcgcctaagatcggcatattttccgggtatgggtcctgcaggtattcccggtacaccagtctggtacaacggtcgatgatcgtcctttcaataggggaaagcccttctttgccgccgatgataaggtcacacagcgacaggataaaatcacttttcaaagtgatcgggttttcatcatcggaatagtccagattgatgtccatagggttaatgtagtttgtggaagtaggggaaatatcaatgacctgcccctgggaaccgaactgctgtaccagcggcccatactcattttccgggtcagcgataatgatgtcgtcctccgtcagaaggaacacattgacgatctcacgcttggcagagaaagatttaccgcttcctggggtaccgagaaacagcccattggggtttttcagcgtttttctgttcgccatgatcaggttattggaaagggcgttcaggccgtaatacaacgcctcgccctcctggaacaattcacaggtggtaaacggtacaaagatcgctgtgctgctggtcgtaagcccgcgctcaatttcaatctggttcgtaccaagagcaagcgaggacataagcccctgttcctgctggtaatccagccgttttaaggcacagttgtatttctgtgccacacccgaagcggcaaaaatatcattgaacagcttttggcgtttgacagcgatattttccaccagtaccgtcacaaggaacatgcgctcattgcggctctgtaaatcctgcaaaagattttttgcttcctctccataggtggcaaggtcggtgggaaatagcgataggtaagcctttgaagttatctccagcttttcccccgcttcacaccggacatgcgactttcaccgcatccggcgttccatcaatcaaacagatttcttagtctccttagtcataccattatgagaattattcgtaagatttggcttctccaaatcaatgggtttcctttttgccaatgttcgcagtttgttcagctttgtgagctgtgaagtatccaatttaagagcggtgagataagaacgaatagtgtcctcatcaattgcgtgtatcagttcatgtactggtgcaagcaccaataccagattttcatacttatctctgcctccaattccttttggcttcttgtgatggcagtgaatttctgatatacactgaaatttctttcccgttaccgcacattttccccattgagcggagaacagtgagatacggttatccgcatactctgtactgcggctgtatgtaggcgctctcattagctgtagcagtaagaaagtgtttatccgcaaatcgtcatggatttcacttcttcctgccgctgtgtaagcgcacacttttcgccgctgactcattggatttttacattgaacatagcttattggataaatcggttctttggattgtgctatatatcttagttgctccgatttcccatatctttggatttccatttttgtcaggtcacggccttcctttttcagccggtgtgtctttccagatttcagcctgtttttgagaactgtattaacagttctgccaatatcaccgcagtctatgctgatgtcagtggctaactggtagtaattctggattcccataaccatggagttgaacagccgtacttccccggcttctccacgtccttttctggggaatttgatatttccgacttgtttagtcaggctggctttaacctttttgtaagctttatcgcacatgtgcgattgaacgacgtactttttcccctttttgcgtagtcggattttgaatccgagaaattcagaatagctccgtctgacgtcaacaactctcgttttctccggtgaaacatcaaggcgcaggcgttctttcagccattgcgtgaccgcaatcagcgtctggtctgcctgttcccttgttctacagagaatccgaaaatcgtctgcatatctcacgatatacatttctttcagccgtgtattccgcattgcccggtacgcatggctttgtatcggacagcctgccgcattttctctgtaagcgtagttttccgttaccgggttgcactgccattggctttctatccaatggtcaagttcattcagcaccacatttgccaatagtggggaaataattccgccttgcggcgttccctttgttgggtgttctgtgttgccgtccggcatgaggattggagctttgagaatcctacggattacatagagcagttctttatcccggatattcagtgaccataactgttttatcagttttgaatggtctacattgtcaaagaaaccttttatgtcaaactctactacatagtgaagtcctgacttttgcataagcctgtaggttgccgctatcgcattttcaaccgaccgatttggacggaatccatagctattgttgctgaacctggcttcgcagataggttccatgacctgcttgatacattgctgtaccaatctatcccagatacaagggattcccagtggcctggtattcccgtttggttttgggatgtctttgcgtcttacgcttcttggggtgtagccgtttttagctcccttgacgattttgcgtacccttgctgtgacttcatcagcggtaagtttaccaatatcagaaatcttcagcttgtctgttcccggcgtaatactcccggtattggatttgatgttccgataggccagcaggatattttctcttgaaagtatcacatccatcaggttctcgaaaatttctcctgcctgacttctggcatacagttcatcaaaggtactttgcatatcgtagtattcagcatggcggagatactccacgcatttggtttttggtttcttctcatttggcatcaggcatcactctcctttacggcgagtgacttctttttgtcatactcgcaatcctaattgcgactaagtgctaagttgcctgtttgactgacttgaggccattcttccgttttcctctttttcgcagaaaacatcatcagttcgacctctgcttttcagcagtagtacagcagcttatatgattcgtctgcttacttcctaatggtagaagcctactgcctttcctcgttccaacaatcctatctttacatatacctttaggtctccgctttaagcctgtcagcttgaacacgcctgtaacgtgctatggtgtttcataacatcaatttttactccaccacactgattagcgatgaacgctaccagcacatttctatgtcgtcatggtatagacccttacattcgcggttttcgtcagtcatatttcaaacattctgaccttgggtattttgtagacctccggcctataggtagcaccgtccacctctggacagctttcgtggggctggtaattatccagcaatccatacggctactctcagccgacttcaccgagcttctgacaggtcagttttcacttacacccgccagtcggagtattaagggggcgtttcagggcgttaccccatcattccacctcttggattgttagttctcctaacatctgaaattttcgttcttttgttagtgcctgattttgtccttcaaccacgaaggctttgttcaggaacgagtcgcactgatgtccatatcatacccggatcggaccgctttcttttgttcctcaatggtcattttctgcaggtccgacattttacgcttgatgtttcggattgcctgtgcctggtcgatagactgaatatgcaggttgacggtcacggcgtcgtttaagtcaagaagatccgctaaaagccggtcagtaagctccggcgccaaaatctgcaaaaaggagacggcaccggaatggtcgcctacccggaatgtctttccatcctttgaaaaagacagcccggatggggaaatgaagtctttggtagaaagaccggtcttaggcagatccgaccactggaaatgaaacttttcctgaccgtccgggtgaagctggccgtgaagaagttccagacgttccagtccgtttaaggatcttgactggactccaagggttttgaaatttgccagcacatccgtttcaatgcgttccagacgcattttcgcagtacgcaggtcatctgcctcgatcccaaaggtaatgtatttgcgtttggtgagaccgttatttcctttctgcaactggttctttaacatatccccgtattccttgcggattccgtcatactcgtcgccgcggggagggatttcaatgcttctggtaaaatcctgcatattggcccgctggttgataaaggtaagctgcacatggatcgaagcatcgaagtaatttaagaaatcgcagtaaccctcgaagatctgtgctttatcatctgcctgtgcaagctgatagttaatatcaaaaaactgtaccgttttggtgtaaagggtatcggtcaaccggcagatcccatcccggtacatttcacggtagggaatgctctgctggactgtctgcggggcatctgctttcagcccggcaaaaaagccgccttttttagacggcttggaacgggctgacttagttttgccctgctttgcatcggctctggtctttttggcctgcctgatatttttttgcagacgcttttcctgagcttcctgctgcttgttttttggcaatctttgtaacctccttctttgacatagatttatacaggttatccgtcctgtatggacggttcttcggccagagcttataacggagccggttcttcaagatcttttctgccggctgtccgtcacgctcatacatggcgaagaagaaaaagggcatcatcagcccgatcatcaaaagtacagccgccgaattgccgatcgccccgcgggtaaagaaatacaccggaaggccgacaagcccggcaaggctgaaacaaataagctggcgcttcgtcagattgaaggccagcttggttttaactttggttaaatcctttggtacaggtacataaggcatctatacacctcccatcgtaatatagtttccggcccattaccgtacaccgaattcgcgtaccggtttctccgcagccggacattcccgcacttcctgagccgcattttgcagccgtgccaagacagaaacagccgatcctctctgacacaggtattcctggctatctcggattccggcaatattttcccgaatatccatatccacgtagaacacatccgaaaccggcataagccaacggtctgcaaagtatttcaaatgattctcaagcgccagcacatcatccaacatttcatccccgaactcaaactttgttgtcagataggaatacgcctcctgcatggctgtaatttcagcagctttttcaattaaggattccttatctcttgacataaggctttcccggtaagcaaagtaattctgtcccagccgtttcatcaggagtgtatatttgtcctgtgcggaaggttcgcttgtgaaatgttcaaatttttgctctgcatcaatttctttgagaagatcgcagatcgggaaactatgttcatggttattttcttcccagcaccatcgggctacgtccaacgggtcctgaaaagaaagaagcgcctctacttccgccggggtaaatacatgttcaaccttcagataatagtggagttccgaaagtccctgtaactcgtaaatactaccgatattctgtgcatccagcatatccgcatgaaccttcaaacactcgtccagccgttccataagcagccgctttgcatcttgttctatcaaaatcacccctttcgctccggcatagtcagcgtacagttcacttcattgccccacacatcccagccgggtgtcttttgtcttgcaaacagttccactctgggctgatcgcccatgagttttacgatcttatcccgcacctcgtccggtttcttgctgtgctgctcaatatgggagattacaaactgatggattcccgcacactggcgtttcggtcggcctctggttgccagcaggcagacctccgcattagatcgggtccaaaagcccatgccataaaaccagctatccgctttccggttctgtttgagccatagaaaagccagcgttttatatttgaatccccaggcatcgatcacccggaaggcttcattgagctgcgggaaggtcgcccacagaaaaagggtgctgtcttttgcggcaagttccgataccggcagggcacagatttcttcaatgctcattgtggggtaatggttctccgcaacgccgcttccatgtttcctatcatagcgccagggcggatcggcatagataatgccgtactgtttcgtttccggcattagcgagcctgatcattcttagatggggcaggtttggccggctgttctttgaccttaccggcattttccttcaatgcaccggtcagggaaggtttttccgcagctccctttgttgcttcaagagttgcttgcaaattttcaatagcctgcccatacccatcgatcagagcgtcattaagctgtttgcggaactctgccgtaaccggccagcagacatctttccagttgcctcccttatcctgggttgcgggcatattgacatacagccccttttcactggaacagatacggaagccgtcaatcttaaagcatccgccaatcgtaacattggcaaacgccagcaggtttcccattggggcgatcggacgcacgcggacatccagcttcatgccgtttgtcatttccggcgtctgtgtctccggcgccattttttctgtattggttttactcatatataaaatcctcctttttagaattggttttgttcatgctatcttgcattaaatatggatttggataacgaacctgtcttaaacagggcaaaggccagcagtaccgtataacccgccgttccccagatcgcgccgtgcacgtcgccggacgatgggatagactggaccagcactgcataaatggcaacacagatcagaatcaaaaacccctgaaaacccagggcaaaaagggaacgcagatacccggttcccatttgtccccattcccggtttgccattgtggaaaacgggatcggtgcaaggctcacggttagtagggtaagaacccggcgccttaccatatcactatggcaggtttccgagaactcccctccgaaccggacttacacctctcgatgtatccggctctccagatgtcagtctaactttcctgcgtgtaacttatcgtgacagtcgatgcagagtgccattgtcttgcgcttacgcccaatcatggcgatttcccattgttttctgccacttaaatctttgagttttcgtatatggtgtatttcaagcggcacattctctgcgccacaccactcacacctgtttgcttgcagtctttttataaggctattacgcccataattctcaaaaattcttgctactatatcaggatttccgctttctactttagtgtcccggcggaacccattattgtaaaacaatacctttccgaccttgccgtttttcttcggatattccacaacaaaatctttcccttgacggtacttgcggataattctgctgattcgtgtccgatattttccagcaaaggttttgagcatactgtatctcattacatagtagaagttattgagtacagacacgttgtttgcaagtcggtagtagttatacaatccacggatttctgcgttgtattggtttaggatttccaaatcgtccaagtgcaacaggcgagtgcgccggacaggctcccaaacctctttgtttccattttgtttgtcgtatttaatcttgagggcattgtaggagaacaatcgttttacccacttatcatggggaacataaagtaagacttttccattgtttacccgtctggtagccccggttttggtctttttgttgtgttcgcctttggcgattgtgacctcatatcccaagaacttcgcagcgtcgtgtccatgagtaatcaatgtcttttcctcggacatttccagatggagtttgtcccggataaagtagcctacatcttgtttaatctgttctgcgtcctctttgctgccgataactccgattaagaaatcatcggcgtatcggatatagcaaagccgtttatagctatcgtccatctggtcgctatacggtatagatttcagactacgccgaagttcccggatttctgcaattaagccctctttttcttccacgctcattttagagatatttcttttaagcctttgttcttttcctcggcagacatccaatttcttcttgaacgcaggattgattttacggcggtttccgcagttgaatttctctgcatactctgccatataactgtccagttcgttcatgtagatgtttgccaggatagggctgatgatggagccttgcggagttccggaataagtattgtggtaattccaatcctccatatatccagctttcaagaacttccagagcagaccgatgaaatattcatctgcaatccgctttcgcaaaatagcaatcaacacatgatggtctacgttgtcaaaacagccctttatatccccctcaacgaaccactttgtccccgtaaaatatttctgcacatatttgagtgccgtatgacagcttctgtttatacggaaaccgtgggaatagtcgctaaaggttggctcataaatactctccaagatgagccgcaccacctcctgtatcagtttatcgtcgaatgacggtatccccagaggacgcattttcccattggatttcgggatatacgttctccttgccgggttaggctggtaactaaaatcccgcatcttttcaatgagggcgtttatccttgccattcccattccgtcaatggttttgccgtctgttccggctgtcatgttgcctggtttcgcctgtatccgctgatatgccagcagatagaattgtggattgtacaggttgcggtataaccgctcgtacttgtaactcttgttacacgccttggattttaggctttccaacacattttcaggacttctcataatgcctcacgcacctttcctttttatgaattggttgacatcctgcctcccttcgccatgtagacggctttcccgccctcggactactacggaggctccgttgccatgccggatattcagcgtcatctttcttgggtttttaccccttgaaatttatcgccttgcggcattacgcatagccggatagttccggcgttccggtttaggcaatctccagttagacactttgggataagcgtattgtgatgtcggtagtgggttttcgtccttttccgcttactgcggctggctgtcataagtatcgtgcggtctgtgtttacctgtcacattccgctatgacatacggcgaatacaaccatcctgcgccgccgggtcgagtatcccgcctcggactacccttaaagcagtttagccttgctcctcattcacaatgttgcgtcttgccgctcagtcgtgggtagatggttttcccaactcgcgatttttccgatacgctattgtcccccttgtggtttccctccggggtaaatcggatgacgctaaagtgacgcgtttcacgtctttgatacttttctttaccggcttgctaaagccggattcccaaaatgtccgcgcaccgcctttggatgaaaagcggcgcttctggacgcgcaataaatctcgatcatacggccatatacaatgacaaagatcacgatggacagtacccacatacacagattgatgatgttggtttccagccacagtccaatcagttcccacattcccattgcttcaagctgggtttccagatcagacaacgccgcctgcacatccaggttcccgtttatgacaccggcactttgcgacaccacattttgagccacatcaaagaccgccatcacaatcgtaaaacagttggtgagcaggtaagtggcaacaaaagtcttgaaaatccacttgaagatgttgaatgtatcgaattcgtgcatgttgttcttttcgagaatcatctggatcagttcatacaccagaacaaaggtcaggatcatgcccgcaatgggaatgacgacagtttccgaaagattttggatcatggaaaatacgccgccattccagccctgcggggtctgtcctacttgatttgccacatccgcaacctgattgttgacggagttgaaaatgctggtgtactgtccggtgatcgcatcgatcaagccctctttaatccagtctgttatccgttcaaacagactgcccataaatcagcccttaaccgaacaggccggaaagcagcgggatcagcgttgcaccaaccagagcgatacctccgcctgccataagctgcttgatcccctgggattttgcacctgatagcgataggtaatcctttgaagttatctccggattttcccccgctccacaccgtgcatgcgactttcaccgcacacggcgctccatcgaattcagccgtccagggcttttaaacacaacttacacacttcgttacagcattaaattcaaagaataataggtggcatttctgccatagtacgaagtttgttaagcttttctatttgtttattgtcaagatttaaggatttcaggtacttctcaatcgtaggttctgaagaagcatggataaggatatgaaccgctttgctgacaagaataagatttgcgtattcatccgaaccgccattgcttaccggtactttatggtggcagtgaatatcgtgggaattcatcggaattcctgtcactgcacatttaccatactgtgccgcatacaaagaaatacggttatccgcatattcaatggttctgccctttacaggatttctcatcagccataacattgtcgctgtgtcgattgcaagattcttatgaatctgttcccgacctttgaccgtatatttattgatggatttccttttatgctgggcattctttgactggacatatcccagtggaaccaccggacgtccatgaaggaacctcatctgtctgcttgctccatacttttctttaataaacccatttctgagttgtccctttttggataagtcgcctttcagtctgtttctgagctgtttgttgatactgaaggcaagtctgctgaagtcatgagatacttctgtagaaatacaatagtattcatgaagtccggcaactacagagttgtatttctgaagctgcatgaactgagcattatcatctgacgaatgagccagtttctttacttcttccgagactttttcatgagcctttttgtatgctttatcgctcatatgagaccgaactacatatttcttaccctttttacggattttcagtttgaacccgagaaaatcagaatactgtcttttgagattaactactttggatttgtcagggctgatttccagccccagcctgtcctttagccataactctgttgccttgtatgctctgacagcatcctcatgtgttgcgcagaaaattttaaaatcatctgcgtaccgaactgcatgcatctcttttagtctgctccggcgcagagccctgtaggcgtggctcttaatctctgttccctgcacattgctccttgttttgaattttgtctttgttggcatctgctcccactgggaagcaatccaccaatccagttcattcaatacgatgtttgcaagcaatggcgacaaaataccgccttgcggggtaccccgtgcgggatatgttttctctccatttggcagaacaacaggtgctttcagcatctcttttataatgcataacagctttttgtcccggattcccaatgcccatatctgacgaatcagctttgtatggctgatattatcaaagaagcctttaatatcgaggtcaaccacatggtacagatgctgtacctgtatcagcctcatgcattgcgcaatagcagtctcagcggaacggttcgggcggaacccgttggagttctcactgaattttgcttcacatatcggctccatgacctgcaaaatacattgctgtacgatccgatctacgatagttggaattcccagaggtctggtctttccattgggctttggtatatccactcgccttacgggtcgtggatgataattactgaattgtttccgtatgagacggacgtattcttcctcgcttaactttgcaaggtcggctatcgtccttttatccactcccgaagtatcacttcctgtattcttctttatcgttctgtatgcaagcttgatattttcttcactctcgatgatttccatcagatggttgaaggttttatctttcttactttctgcatacagcctgtcaaaagtaccttccatgtcgtaatactctgagttgcggatttttctctgtttacttttcctttcttgctgccccgaagtcaacacaggcatcctctcccttcggtttggattttctttgtcatactcgaagctgtgtttgttgtgttttcattttctttgctgaattcgacttgtggctatccctccaccgcttacttattcacggcttcacaggtactgtgccactactctcactggaataaagaatggttattgccctctcgcgaaggtattcccatccaccacatcactggcttgcaaccgcctccgtgttcccagctttccacgttccgatattcctatcattggatatctttaggttcttcctctaagcctgtatctggtcatgcataaccgcaccgcctgtaacgatgcatggactttcataacaaccaattttactcgcccacagataccaccatgaaaggtgtactgcctttcgacagcatcaacgtttagactcgtacattcagaatttcgtcagtattttcatacattctcaccatggatatccgacccccggcatataggcaacaccatccacctctggacagctttcgtgtctggtctgaaaaccagtcttacggttgctctctgccgacttcaccgagctctataaacttttggagagagccgttgcatgctccccgccattcggagtattagggtggcgcttcgggacgttaccccctcatttcacccatcggaatatcagttctccaaagtttcgggctacaattgcccttcgactttgtgcgcaagcttttcacttacgaacgtgtcgcacggttatcatttccgtaaccttcgagaaggtttacaacaccccatgcgcccagacctgcgcccagggcgatcacaaggatcttcaaagtatcaatcgcgcttgcaaaaaatgccatatagttcctcctttaatttcagaaattttaatttgtgatatggccgtatcaggccggaaacaaaaaaagccgccgcactgttttagaaaaaatctgtttcaaacagcacggcggcatggggcaggaaaaatcctgcggttatttacttttcagggagaatcacgaatcctcaaaaaatcctcctttcatcgtgacaaaaacaaagcctgccgggacgtcatgctttgacaggcaggaacaactttataaagtctgggaatccagatcttcggctgtgacttcataattgcggtatcgttcaccgggacgcatcggcatccgggtagaaagaaacttttcgatattaaaagcgttcttctcattaaaatcggaaagcagtttgtaatttgggtgtttggttatatcatatttccgggagaggaacggccgcacacccctgatctgcaacagacatttacccccgtccatgaccgccagttcatccaccgacatcagatcctttcccagcttttgaaaattttgtccgtgggattcctgattgccctttgtgacactggtgttatacaggtcgatggtctctttccccaatagggagttccagctttttaaggtggtttcttctttgcctcctaagaaaatggaggcgtcacagttaccgatgatggtgtccatgttgtctttatacagggctttgagctggctttgcgcctgcagcaccaggcaggcagagatctcacggcttcggatggtcgccataagacgttccagattcggaatctgcccgatatttgccgcctcgtcgatcaggcagcgtacatggatgggaagcctgcccccatacacatcatccgcccgctcgcacaagcggttaaacaaaatggaatagatcagactgatcaaaaatgcaaaggttccgtccgtatcactcataataaggaaaagagcggtccgttcatcccccagcatatccagatccagttcgtcatacatggtaatttccctgacttctttaatgtcaaaaggagccagtctggaagcacaggaaataaggatcgacttcgctgtttttccggcagcaagcttatatttcttatattgacgcagggcaaaatgatccgggtctttctgttccagcgcgtcaaagagaaggtcaacggcatttttgaacgactcatcatcctcacggacttccattgcgttcagcatttctaccagtgtggcaaaattctgttcgtttgccggagcctcataatagatatatccgatcagtgccgtatagagcagggtttctgccttgacccagaaatcgtctccggcttttccttcgcctttggtattggcgatcagagtcgtgacgatcttcaaaatatctttctcggagtggatgtaggcaaaggggttaaagtgcatacttttctgaaaattgatcgtattgaatacccgtattttatagggctcatagatgatctttcctttttcattacgcacaggctttccgtccttgtccagctttggtgtgcctcgctgcaacatctttccgcattccacaaggactgtacctttcggatcggtgacgacgtaggaactgtgcatttgcatcagattgggcttgatgaaaaagcgcgtttttcccgaacctgatcctccgactaccagtacatttttatttcttgcattggccggatttttgggccttccgtttaacatcagtccttcactttgggtaagaatgatattgttttccggctttgggtccataaacggggcaatatcggctttatttccccaacgggctgaaccgtattccacatttttgcggtatttcttagcgtctttccctctaagatagactgccagccgcataatggctgcaccgcataaaccgatcagccagtccattgccgcccccggccacatactctgaaacgcaaaggcaaagccttcggacagtcctaacagcttttgggaagcgtccgctccgggagccagacgcaccgcctcgcccagcttggcaaataccagaaggaacagaacataaggcagatggagaatgacctgttttttcagtgtttctgcatcgatcttcatcgttccggtcctccgtgttctttgttctttacacggtcacggccaagcgactgcgccagttctttgaacttatgaagctgtgtaagcagcgacggtctggtgctgcgtgtaaggtctttcttcgtatattccttaaaagctgccgtcagtgcatccgcctggtttgccttgaaatataccgtccattttgggggaacagtcccaagttccttttctatatggtagcgtacctgatgtttcctggcataccgttcaaaagagcggattcgccctgaaacttcaatggtattggctccggggtctttataagtcagccgcttcatgctgttgcgcccgacttttggcattatgcgttcctgttccatcttttggagtaccgcagcaatagccgcacgcagtacccgccctgacagttttgctgcctgtatggagacagaaaccgttcgttgttcgagatcttcctgcaagagcatcctcctttctgataaaatcggtatttataatatggaaataactttttaccggctttccccaagaacctgctgtcgggaagcgtgttcaaaggcttttgctgcctgatcgacctggattttagcgtgtttcaaaagcgtcttgatgatcgtagccggacgttcctgttcctccagatgatcgaccatccctttgcactcatccgggaggtattccgccatatctttcaacacatcggaaaagttacccataaagccccagcagctatccgacagttccccgtttttataaagctcaaacccataacattcgccacgcagataggaatcgtaagcggcgacttcactgcgcatcagtgcgtccgctttctgccggatggcgccggtcatcttgtcagcgtcaaattcctttagggcatcttctttggaaacatagatccagccgacctgtccgctgtcccattctgcatgaggagccctgcctgagaaactttctgtactcatggcaagaccggagtggtcgtagagatagagggggagcatcagatacttttccgaaattactttctgcattgcttcatcgatcgcccgttcctctgtctttgatccatgccggaaacggctgcttacaatgtttaccatccgttcatagcgtttcatgccggcttcatcatgtcctacggtatctaaatacatttcccgcagaaagtcgtctttgtccatatagttgtgatggtcgcccagcgcatagcggggatgaaagcataccatcgtcccaaaatgttcatctacctcacggggagagatcagaatatcgtccggctgcaccataagggcataaggttcatttactgccattaacataattggctcctttctttctacaaatccgggccggaatggtgcatcatcggtttttcccggtgttcattggttgcaggctgcttgactgcaatgatctcgccggcaatccttgcaaatttttcagggtacttgaactgctccccatatttctccatcagatccggggaaaggtctgtaaaattttcctcgccaagaccaacgatcagaaaattcccgggcacaatatcatagatgtggccgtcatcgtcaaagagagcacggttcagaggcagccccatcagcttgccttcttcattacagatcagagctaccgggtcctcatacggatagaccgcctgaatatctccgcccactgccgcctgcaaggatttcagaccactttcgatctccgcagcataaggggacttgcccggttctaccattaacactttcataattgtatatcctccttctttttcattgccgtaccgggagcggttggcgttttttcctgagtttttgccacagagagcttctcaaggacagaagaacgtccttcattaaacatggatagctgaccgtccgctgcctcacgaagttcagaaacagagaggggaagcgttacatcggcatgggtcaatagctgttcccgtttcaaatcctgaatgatcttgtcaaaaacggcgttgatcgcacggcgttcttcccccacagggaaggctttcaatacctccatttctccgtctttaccggaaagcagggtaagggcacagtcggcatggcctgccagataatccgatgtgtagggcagtttgtccttgatataacaggcaaaggctctggctgtcatttccacattgctgtcccaataaccgccgtctttttcacattcttttcccatgcgtaccgaattacggtaaaaatcagtttccgtccgtccaatctgcggagcttcctgcgcctgcatcccggaaagcatacgctcaaaaatttccagccgttcccgttcacttttgggaattacccggccggtaacattcttcttaaatgcgctgatctgttccacagagccgggttcgccggacaaaaatgcttcccgcaagactgcgtaggtttccatctgttcctcattgccataccgtttcagggaggcaagaaccgaggaatccagccagcttgccgcatttttccgggtgcgttctgtttgtgctttcgtgcgctttgctgcctgttccggtgtttccggtttatacttcatggtgtcaatgagcttttggaacggcgcatagaggcggggctgttctgacagcatcccttttgcgcccatctttgtaccaagataatcgtcaagcccatgccaccattcatgtgccagcgaaccggccccgtgcattttcgtaagattgatgactgtacgcaaaggttcataatgagccgcagcattgccgctgcctcttgcaccaaaagcaatcgcaagcgttccctgataagcaatatctttatcgctgatcttaagagctgacgccagatcctttagtgcttcaaatcccatgttaagggaggtctgacggtcgttctggttcatccagtttccaaactcgccgccgcggaacccaaatgtatcaagataatgctgtccggtgatctccacaccattccggtaatccggcccggtacgtttgacatgggcgagctggggaggaacaaaccggatctttccgtttttgttcctgcctttggcaagttcctgcacccatttcagggcagcttctttggtctcaaaattggtccgcaggatcgaatagccttttgtcacatagtaggtaccgggtttccagtcctcatttttagaataggtatgtttcccgtcgttgaagtggatcgcataacctttcggtattttctgctctttggaaacacaaaactgttccttttttgctttctgagtaaagttgcgctcaaaatattcagccgagcggatcagcatggtattggacaatttgtttgtgatcacgggattgtcctgtccctttttcgttgcccggtaatggattccgcttccccagccctgtaccttttctaaatatccattgtcaacgaaaaagcggtcataggctctcacagcatcctccacagtacggacatctgaaagcactgtctgcaattcccggactgtttttatatattccttttgtctcgcggtccgtttttccggggtgtcatccatgcggtaatactgaggggaagcgtttaagccgtcccttgcttttttaataaaatagaccacgccaagaggaatcccttcctccagcatggctgcatagtccggctttttccagacattatcttttttcacaaatttttcggcttcgcgctcattcatggcttccagatcatctgcatacagcccgcggtctttccacaggtcttttttcgcaccgccgatcttttcgccgaaatcttcatgcactcctgccaatcttcatcacctccagtcagtgtaaaattcttatcgctccggggcagggcggcgttcttcgtttttgtgaagttgtgggagatttcctgtgagccggtcagtttccctgcggatcagtttgtccagagtgcctaaatcctccggtgcaatggcaaactcccggtaattttcataccacaggcccgtagagactgccgcgatgggcgcgattttctccgaaccggatggaagaaggcgatacacaggggcttcgtcataaagaagcatctgctttgccgttccctgtggtatgcggtacttatccatatccgggttctgggctgcctccatatattgcatattcaggcgttcttctaaatcctggggcatataacgaaatgccatatccatccactgtctgaacatcgtggaatagtggtactgccattccgtaacttgattcggggcataagaaaatccccagcttttcaaggcatctttttcgtaaagctccatttcagtccattctttcaggctgaccgtagccgctgaaccatctttgcgttcgatattgacgccgcaaggatagaggatatttctttttatatcctgccgcagcgtgtctaaatccatcatcaggacatctccgtacaagtgaccgtcctctctgcgatccgtatgaaacaggaaagccctcgctccgatgaactccgttgttaagatcatttgatgaaggtctgccgtagaacaataagcaaacaaggcgtcggaaagccacatgtgatttttccccatgatggcaatggaatcagccccggtatttgtcgccagagaacgcatattaaattcgcattccctaagaaaatctccggcaaaaatatggatctcatacgcaaagacggataagtctgtatcacggatcaaatgaatctgcggtagtggttcctgattcaatcaaattcctcctttcatgtgaacctgacaattaccggctttccttatcatgggaaggtgccggcggcttttttgccggttccgtttttgctgcctgttcccgcattgcttccaaaacagaagggcgcctttccgcagtctgttccaaccgggcaagggtattaagtgcccactccgcattacggttaatggaggatataagggcgccctccactttgaaagcacctttgaacaccctggcaacctttccgttttcttttgcgtctgtctccgcaggttttccttgaatagcacggcccatatttttgagatgccgccccatttcgtgatattccgtactgaaagcatcaattctggcaacagccctgttgctggcctgcatacttttttctgctgcactttgaatggactccaacaccggtctgacatgtaaaaactgtgtgatcccattcaaagcaacagtaccgcgttccctgaaatcggtaaggatattcctgcatccgtttatgatctggcttttgagttcggaaagacggtgacgcataacggaaatattcgcctccatagctgtatagctcttttggagagcatctttcagagaatggttctgtaatccctgcatttcctgacgtactgcctttaattcctcggttgcctccgaaagacgctgctccatcccagtcacatgctcgatcagcttggaaaattcttcatatcccggtgtgttgttgtcttttaggagagcaagcagctctttgacctgctcattttccgcaatcggctggctatctgtctccgtcattcatcaatccctcccatctgccggtagcggccctccggcaatcttgccgacaatctccggaccagtttcataaatctgcatgaggcgttttgctgtgccgcagggctgtgcagctccgctggtccaaagacgcactgtggatggggcaacattcatcaaaagcgcaaagcccttttcgttcatgtccagctttttcatcagcgatttaaccatatcggggccgtagtctgggcaccgggaagcctcggcaatcatctgcaaagcggtattttcaatttttttcattttcaaatcctcctgttatttgttttccagccttatgccggggcgaagctgatctggttgtgtttcatccttttggcaaagtccggcagcgaataatttaccccgtcaatttctgcatgggtgtcatccagacgatggcaaacagcaaaatgcctgtctccgtttccatagaacaggcagagtaaaccattgtcaggaatggaaaacagcgtttttccggcgctgtctgtaaagcagatctgttgagatccattcatgttgaaatcctccctaaatcaggaccacccgtccaacgggtggtttgctctagggctataagcccttgttactaggccagcgtctcaaggcgctggctttctctttcggctatgagaattctgtttacacagccttcccacagctccgttcaagccatattgctcttgactcgtcgctaccccttaaggggcattgttactacttggcattaacccttaaaagggtcttcatattcttttacacttaacttatccattgcaatgtcgtgcttttcttgttcctggatatatttttttattgttgcctcatttaatccgactgtgctaacataatatccttctgcccagaaatgacgatttccaaatttatattttaagtttgcgtgtttatcgaatatcataagcgcacttttcccttttaagtatcccatgaatgatgatacgcttatctttggcggaatacttactaacatatggatatgatctggcattagatgtccttcaataatttcaacacctttataaccgcacagttgctttataatatctcttatgtcctctttgtattgattgtaaattacttttcgtctatactttggtgtgaagacgatatgatatttgcacatccatttcgtatgtgcgagtgaattttctttcttcgccataaattacctttcctttctgcaatatagcctgaacaactttattgtaaatcgaaaggtaatttttttgtataacaatcgacgcgcacccgcatagcgggtggttaaatgttgagtgaaattccatttttcggaacagcgaaaaactccatctcactcaacaggctaaagcccataattgaaacagccgcctcttttgggcggcgttggtgctggctggtttgcagttgttcccgaacctgcagcaatttctcattgtaatcttttcccatccggggagggttgacacttacccggatatgacggaaacgtttatcctcgtggagcatggtcttgattttccgggcattgacaaatccggcaaggtcgtggtccatataaagggtaacacaccggatctccgggtggcgttccaggaaagaagtcagcgccacatgggaagtacctcccaaagacaagcggtaaccattccatttccatccctccagctcttgaagcgttgcatgggaaagcgcatcaataggggcttcaaagactgccacatgccggctgcccggactttgcggaggatagcaaaagttatatcctttgtcgctgccatagacatcctttttgagattgccgccgatactgcgcatacaggcgaacttcgctttcccggaatcatctttccctacaaacacacaaaccggttctccatgataccgggcttcgtaaaaaatcccggcttgtaaacactggcgaatgacttctgagctgatcccccgtttctgcaaataggagaccgcggcggtcgcgcaacgtctggcccaggggagagagaatgctttcttttccggttcttttgatacctgtatttctgccgtacttcggtaagccggtgtatgtcggatttctccacctaccagagcatgaaccgcatccacaagaccatatccccgaatctggatcaggtagtccagcgcattgatactccgtccacggctgttccagtaccagtaccttttccctgtcacatataccagactgtcatgttccttatgccggaaattaggtccatcccgtttcagcacaccgggttcatggaactgcaggtaagtaaacagatcagcttcccgcgctgcctgaatctgttctttggttacgccgggcattgtaccggcacagtgattcttttcatcgtgctttgcctccttcctgtgatggaatgaaaaaagacacccaaaggtgcctaacagccgtacagatcgtgattgacctcggcacggtaatagctgtccattgtagccggggcattatacagcgccgccagcagatatgctttgatatttccgaccttcgtcgtgttcttgtcgatacagtcaaagacatactctaagtggccggaattgatcttcaggaaccggctcttgacgatctccctcggaaaatcatctccggcaatgcgaatgtaagggcgtttcgacaaaatcacttcaagcataagttcaagggcttcgtccagacgttccctgccataccgtaagaccagtaagtcatattcaatattttctttgatgatttcacgataggcttctatcagctctatccgatccatcccatccgtgcggcttgccgcttccggctctgccggatagattgatggataagttattgatttatctttttttgatttttttgtttttaatggattagtatttaattgtgccggatttgcctgttcaggttccgcctgtttaggttttgcctgttcaggttttacctgtcttggattttcccgtttaggtgaaagccctgtgttttcggtgcttacaggctgctcatggatcgtatattcaatgtctcccaactgcccgttatcatagcggagacgctgtctggtgagataaccatgccgctccagttccttcagggcagtagtgatagaatccacaccgtccttgcagatatgggcgagtcccttcgtggtataatcccaatcttccggcagcgacaacataagtgataaaagcccctttgcctttaaggacaactccgtattgcgcagatggtgattgctcattatcgtaaagtcctttgttttctctacacggaatactgccattgtatcgccacctttcttcgactattctgttacaaggcatgatccctgtggtcataatggagatgaccgccagagaccttcgcatggtttttcagtttcacttcgccccgttcctggctctctaaaaatttctgatagccggcatctgtaaggaacaagcgcatcttatcgcctttgtcgccaacaggggaatcgtaagacaatacatcaaaaacgatcatgtgccttacctccgggtcaaagcgttcaagtgccatgatgtcatgccccttcaatttttctgcacctgattgctgtctggcctcggcgatcttttctccaatcgtccgggctggatagggcagacggtaattcttctgaatatcttttaccaagtccatgcactctgcatttgacagaacacgaagttttgcaataagaccttctgccgcctcccgctgttcggaattatttgaataccgcacggtcatataaagttcattcaggatctttgtctgataatcgccctccatctgaaagagcagctttttttccatttcgtttaattccatggggatctcctttctcttgaaaataggtatgaaaaaagggcgcccacctataaaagtgaaacgccctttggcttatacactattaaattttatatacaaagcaagtttgtcgctgttatgccacattttgctggtatctcaatgttacctttccatcattaaacggatggatgcacaagaagtctataataaacatgggaattaacaaaagtgagtctgcttcgcctttgttgattgcttcattataagctgtacataaattaatgattgcgtctggtgtctcccaggcaggtaatggtctgaacctaacaaacttattgcccctttcatcttcttcctcaataatattatcagttgtcttgaatcttcctccattagaggtattctcgaatttatataaatctctatgtaactgtaatataaatgtatctcgaatcggaatatgttgaaaattctcatgtattgtgtttagcacgtccctatatcccgctatctcacgctcatttctcgtctttggcattgtcttatctaaaacaatttttttcaatcgttcatcagaagtataaataccctcaattttattagagctttctgtactttgaatccttgccatctcaacaagattttccagtacatcagcatggcgttcagcaatcaagtgctgtttacctttgtactcatgaattgttgtaagataacttacaatttctggtgtaagcaattttttccatttttccgtgtaatcaaattgtttcattttaattacctcattttgaatttaacttcgtctttttaacaaaatgacttaattgaattatatcttttaatttaatcaaaatcaagttcaatttagtcatttaagcacaaatgactaaattgaacttgttatgatgcaattctaaaataatccagatagcctttttcgttgtcccattccttcaatccacgataatagaacattttcaaattgtccccaatgataaacggaacaatattgtattttaggcactccttaaacataatcagtctgcccacacgaccgtttccgtcctggaccgggtgaatccgcatcatcagaaacagttaattcaaaatgatttctatttgtttttataaagccctctttttgtaactttgatatctctgtagacattgctgcacgatcaatacaaagataatctgctagctgctgcctatcaaaaggaatatcaaaagataacgacgaatgtctgatagattctgccgacagatatgataatagtttatctctcgtcgttcgcttcccaacatgcgtgatcttatcgttcagaatcagtatcttatttgccaggacactgaccagattacggatcagcttctgatgatgctcacacgcagttggacaggtaatcagaagtcttttgacatttaagagaataatctcacaatcctcatctgctaccacactgatatttaagacagctctctggcttgcggcatacggctcaccaaaaaaatctcctgcgtgacattttgacaaaatattccgatgtccccagatgtcttcttgaataatgaggacgcagccggacaccacaatccccattacttcggtaatatcacctgctctgaaaatataagaatctcgctttttagaaattgtttttgcgtttacacaatgcaatatggataaaatctcgttatcagttagacctttaaaaaatggactgtttcttaggattgataaatatttttgcaaaatagttcctccctgttggaaatcaaacatactagttgtatttataatactataattctagcataaacaaacgctaaatactattgacggaggttaaaaatgataagaaagattataaagattgataaagaaaaatgtaacggctgtggtgcctgtgcatctgcctgccacgaaggcgccattgatatcattgacggaaaagcagaattggtgagagaacatttctgcgacggactgggagattgtctccctgaatgccctaccggagccatctcatttgaggagagagaagctcctgcatatgatgaagaagccgtaaaagaagctcagaagaaaatagctgccaaaaaccgggcaatatcctctcactccggctgtcccggatctaaaatcatgcagatcagacgaactgaagcatctaagccggtaaaagccacttcaaccgcagattcaggatcaaagcttcaaaactggcctgtacagattaaactggctcctgttaatgcaccatattttaacggctcaaagcttttaatcgcagctgattgtactgcttacgcttatgccgcctttcatcaggattttattcgaaacaaggtaactttaatcggttgtcctaaattagatcaggtggattatagtgaaaagctgactgctattattcaaaataacaacattcaaagtgtaactattgtccgaatggaagttccttgttgtggcggtctggagattgcgaccaaaaaagctcttcaagctagtggaaaattcataccatggcaagttgtaacaataagtattgacggaaaaatcatggagtaaagtcagcaaccaccagttcaactggtggtttgctatattccctctattaagcttccctgcacttctcatatgcaaaaagtgctgcaccaagcgctccgcaaagctgtgcctcatcgcaaatatacagctttgcgccaagcttttcttcaagcgcatttgtgatgcctttgttctttgccactccgcctgtcatcatatactcacccggattatcctgcccaagccttgctgcaagtgcgcctacctttgaagctacagacatgtttagtccgtggataatatcagaaacagccttgttctgtgccaccagcgatactacctcagactctgcaaaaactgtacacatgcttgaaatcacaatgttttccttccactcaagtcccatggtgctcatctcctcaagtgaaagtccgagggtccttgccatcatctccagaaaacgtccggttcctgccgcacatttatcattcatcaggaaatttttgaccgcaccattttcatctatgctgattgcctttatatcctgtccacctatgtcaataactgtgcgcacgttgggattcagataatgcgcgccctttgcatggcatgtaatctctgtgatgctgtcatcaccgctattgatatatgcacgaccatatcctgttgtaacaatccttacaatatcatcctttgatataccggccttttcgacagccttctccagactcttttcggcgctcatcatagcgccgccacctgttggaataatcattgtcgatttaattttcccatcctgatccagtatcaccacatcggtgcttgttgagccgctgtcaattcctgctacatagtagactcctgattccatccttcttcttgcctcctcgcttatgccttttgtagggtccatgtcatctgagccctctattgtctctgcaaatgcctgtattcttgtcaaaagctgcccggcactctggcttgtaaaatccgtctcaagctttaaaagaggcaccttaatattattctttatgcttgcatactcaaaaccatagtaatcgcagaactttatcgtgtgatatatgatgcccttaagacttgggtctaaaaagagctggtttcttcttgtattattgttcattctggcacatggcatctgtccgagcagactctctgcatatgctacaaagagagtctcatcatccatatttctaagatccttctgtaaaataatgagatttctgccggatgtgcatgtcatattttccacatccatctgcatattttcacgtattgtcttctcaagaatactgctcacatgcacacccataagacctatgtatggcttgcgctcagattcaggttttgcaaacgactttataaaaagctccctgtcgaatgtcctgtgcgaatatctctcatacgcattcttcaaacgaagaattgactgtgcaaattttatgttctcacactcgttatcctcatgaggcagatcaagcatatacaggaatttgcatttctttgtattctctatgatatcatagactctgcgcattgaatcacagcagttcacgagcacaagctcctctaccttgccctcgagcacagcctgtatgactgatttgccgaatccacagagattcgcatgagctatcttatctgatttatcgaaattctccggcatctcctcaagcacagcacattcctgcccaaagcccttaaacaactctaccggagcatatttacaaacataatttatcatctgttttccactttctgaaattgttttatagtaaatatccacacaccacacacaataaccggtgtattatttctaattacgttcctgctctgcaagcatctccacaaatgcctgaagccttgtggaaatctgtccatcgctggcatttgccgggttgcagccgtctccgtctaaaaccatagttggaagcccttccctctcgagtgagcgctttataaggcttgatgcaccgattgtattcttacagccccagtgcgcaaaaagtacagcaccgtccgctccaactgtgtcggcaagctcctttgcctcctctattctctggttcacgctgccattataaatgcagtaaaccattttttcggcaagtgcctcgtatgggtcatccgactccatgcttctgaaaccatccgctataaaatcgcttgcactgatatggattgtatcactgtaattgaacacatccttcactgcatcctgcaaaaacggcatggtgtgcatccaaagtacatgaaagccatctcctgccggtgcacgtctcacatcatctctcagaagctgtgtatatctgactgattcatcagttcctgcaagcagatgacacatgaaaagcgcatacagctcatttgtgagagtcgacgcaatatcatgtccttttctcaggtgaagctgcctgtaataattatttgatgcaattttgctcttatctacagcctttttcacagactcctctgtgatttctctgccggtgacatcctgcaaaaaactcttaagctctctaagctgctttgctacatacataacagagtcataattcttctcatatggaacatctatataaaagcttggtatttcatatctttcctttagatacggaaatgtcatcatattgccatcgcatgccaggtttgtatacaccatgcactttggctttggcactataccatttaaggctgcgcccagaaaaaccctgtgatacgagcacatagtttccggaaagccttccttctcagtctgccttagaaaggcctgctcgcatttagttcctgcaataaaacacgataatgcctcaaccgaatatggtgtgagacctgccgccgtcaaaagctcacccggtacaaaaatactaaccatggcggcattttcaggctttgcaagtgcctgtatgatattattcatgacaatctttgccacatactgccctgacatcggaagctttctgtccggaaataatgctaatcttttttcctgtaatctatatcctgcaagtaaaatcttcctcgccttgacaggatctttttctgctatctcgcctactttttctccaaatttatctactatactcatgtgatatttcagctcttttctatattcaaatatatatatattcggttcaccatactattatagcaattatgcacaaaaagtaaactctcattttagctatatttcactataactattgtcagatatccttttgcttcggtaagctcatccagccccctgtacacacgctcagactccatgccacagttcgtcacaccatacactgtcattttcttttttctgatagcatctcctgtgcgaagcacctctataagctctgcaagcttctttccggatttcatgtatacacaggttccaccgtagcccacagtatccctcacatcatacgaagccggtatgatatgtatctcatccatcatctcaccaagcgaaatgccaagccgcgctgcagctgcacaaaacgacggcacaccgcttatcatcactgccgtaaaaccagcctgcatgacacgcttatggatatacatatatgtcgaatacacgcttggatcgccgattgtaagcattgccacatttttgccatcttcaagctcacagactatgtcactgtatatcttattgtgtgatatagtaagcttttccttgtcctttatcatgggaaacggagtgcacataatctgttttttctctatctccggtaaaacagcctgcactatgctgtacgcatagcattcctcttttgaaactgcagggattgcaattatatcacatgcttttattgtattaatagcctttaaagtcataagctcgggatctcccggacctacaccgatgccatataacacaccaatattatttttattgtcatcaccggctctttctatctgcttgtccatctttataatttcctgctttctataccacatttacaagtaatgcattcctaacaaaatcatcacacatcgatatcatatattcttcttgtatcaattaccgtctctgtaccattatcatccacaactatcatcaggtgccctatgctatcaagctttttaagataccctgtcacatgctcatagctgccaccctccttgtgctcatccggcacaaaatatgtcacctcaaaataattctctgccatggtgtttatgacattttcgtcatataaactgtctgaattgaaattacgctttctataaagcatcatgagctcattcattttctcatcaagctctctttttttgtcctcatcaggctcatgccactcgtttgttagcctcgctgtctctgcaatagactcctcatgacctgtaagtgccgcaaaaggtgcaaactgtgctgagcggtcccatatagacatctgcggatgtacctttgacacatgatgtggtaaatctataatatcatcatattttcccatgccatgctccttatatactttttcgtaactattttaaaccactaagaaaaatccgattaagaaccacagcggttgctgctatgccttgtgtccgccaatctgattgttccttgaaatagttgtggcaccctcctcaagattcattccctttagcatggcattctttccatatttcttcttgacggaaatcatagcctcctgaagctttctctccttggaaagcgcctcatcctctttcttcttttccttagccctctcctgataatctgtaaataaatcaagctgctcaaactgctcactttcctgcaccttgctctcatcacagaccctgtttgccaccacagtaatccttcgtgtcagaagagaaggatctatgatacggtcataaagctccatcacagcatccatgatgatgcgcgtggatgacgtataacgccctaaatttgctgtaccatgtgcatgctttggaacctttctgccgtatcggtctatggtaatctcacctgtataatctctgtgtgtaccttttttaccgccaatactgtctctgcctttattatttactgcgtggtcataattattgccaaaacagctatcagccttattagacagatttgcaatatcataccctatagtgagtactatctggtctgtaaccagcctcttatctaccagatcaagcacaagaaggtccgtcatctcacgcacaataagctttgtcttctcataatcatacggctcctgaagcacctgccctgaactgatgctgttggtctgcggtctgtatgccttgatatcagctattgtaacaggctcatacccccatgcatggtctataagaagctctgcattgatgccaaacatcttatacagcttttcctcattgtaaaaatcattcgaaccgcctgttgagcacctggccacatctcccattgtatacatgccggctgcctcgagctttttggcataacctgctcccactctccagaaatcggtaatcggcctatggtcccatagctttcgcctatagctattttcattaagctctgctatacgcactcctcgctcatcaggcttggcatgctttgccataatatccatggctatcttgcacagatacagattggtaccaatgccgcaggttgccgtgataccggtatccttaaggacatcgtctatcatcttagacgcaagctcccttgccgtcatgtgataagtgcgaagatagtgtgtcacatccataaaaacctcatctatcgagtaaacactgatatcctcaggtgcgatatacttaagataaatattgtatatgcgtgtactgtaatccatatacaaagccatacgcggcggtgcaacaatgtatgtcagctcatactcaggatgtgcgtcaagcagattcgcattatatgatgcataatcaaagcctgtcattgtgctttctgttatatcattttctgctatatcaatttctgttacatatttttttctctcatccggattgccctcagtctgaattcttttttgctgttcacctgccgattgttttctatcagattgttcgccctcaatttgtcgacttctttccactgtcccggcagcatgtccactcgccataagcttcgacagacgcagcttgtttacctccttcacacgctgtaccacctcaaaaaggcgcgccctgcccggtatgccatatgccttaagagccggcgatactgcaagacagatagtcttctccgtgcgggttggatctgccacgaccagattagtggtcagagcatcctttcccctctctctgcactctactgatgcgtaaaatgattttaaatctattgccacataaatgtgctcttcattatgcttgtccatactgcaattttacattgattactctaaaatgtcaagaacatatgtttgtatatgtgaattatatcctcacacaacaatgccccgccaagaatggcggggcaaggcgttatgtgccatggacggcacataaaagctaattatatcattttcgtactaataaccactatgaatcactaagctttaaaacactacactacaaggaagaacttcacaaggaagagaagcgaaatagcataagtaaggatagaaacctcctttgcttttcctgtaaagaccttgagtacagtatatgtgataagtcctagacctataccatgtccgatagatccggagataggcattgcaataagcatgagtgctaccggagcaacctgtgagagatcctcgaaatccaccttcttaagaccgccaagcatcaggataccaacatagataagtgctgatgatgttgctgcggcaggaatgattgctgcaagcggtgctataaagacgcatgcaaggaacaggatacctgttgtgaaagctgtaagacctgttcgtccaccggcctctacacctgatgcagactcaacaaaagttgttactgtagatgtacctgttacggcaccaaccactgtggcaactgaatcggaaaccaaagcctccttcatgtttggcatatttccctctttgtcaaccattcctgctcgtgatgcagtaccaacaagtgttccgatggtatcaaacatatctatgatacagaatgtgatgatgagtgaaattgctgtaaaccatccaatactgatgaaatccttgaaatcgaacttgaacagtgttgtatctgccatatccttaaactgtggtacaaatgaagctgttgcaagtgatgcaaaaggatttgttccaaagaatatagcctctcctgcccagtaaactacgcaggctgcaagcataccaaaaagtactgctccgttgacgcccttatgagctaaaataatgataacaaaaagtccgatgaacatagtcacaacagtgagcaccattgaagaatatccatctgtcatatttgttttggcaagtcccggtgtgagtgcaccgaagaaatccttcatcacataaaatggtccgccatcctttgagtaaacaccggcatttgatccaaaaccgatatttaaaagcataagaccgatagccggtgaaatacccatgcggacaccataaggaatggcatctactatcttgtcacggatattgaatatcgaaagtatgaagaataaaataccctcaataaggatgatacacagtgcagcctggaatgaatcaacatatgacaggcctgtgatgcttacgatattggcaactactacagcaaagaagctgttaagtcccatacccggagccagtgcaaatggcttgttggcaagaaatgccatgacaaacataccgactgccgaagcaatacatgttgccaggaacactccgttccataatgcttttgttccctcagcaccaaatccggtgaggaggtttgggttaagagcaatgatgtatgccatagtcatgaatgttgtcagaccggcaagaatctctgtcttgaccgttgtgttgttttgtttgagtttgaagattttctctaacatttttcttcctttcattttatctttttttgcagctgttatccgctttcctgctacaggcgcctgttaatagctgcattgtatataaaattgtgaatcacaattgattccttgttttttccacgaactcactcgtgaaaacatcaagtgtaaacggcttcaaactaaattctcatcagtgcttttcaatttcatcaaatactctgtcagccacctgcggcagctcagagaatttgcgaatagccggcacatcgtcatctattgtgccgaacccgtatgctgcatggatgaacttaactcctgcctttttgctggaatcgtagtctccctgtatgtcacctacatacactgcctcatctatattattgcgctctacaataagctttatgttttctgacttctcaagctcattgttgccgtagcactcagtatccttaaaatacctgccaagtccgtggtacgcaaaaaaagactctatataaccacgctggcaattgctgactatataaaggtcatatctttctgacagctcatcaagtgtcttttcaacatcaggataaagctctcccccatgaacggtcaggtaatcgttttcttctctatagcatacattaattaactcatctctgcaagtacaattaggaaagataatggatgcaagtacatccattgtctttcccattactgaatacatatcttcttttgtgataggtgccctctcatagccataatctgctatggccttattccatgattttgccacattctctgctgaatcccagagagtgccatccatatcaaaaataatacccttatgcttcatctattgcctttccgatatcatgtctcatgtatttattatcaaactgtacccactctgttgcctcgtaagccttggctctggcctccttgagtgtggcgcctgttgcagtgataccaagcacacgtcctccgtttgtgacgatattgccgtcagcatcaaatttggtgccggcatgatagcagtaataatcctctttgccgtcaaacttctcaaagccagttatcttaaagcccttctcatacttgacaggatatccgtctgatgccagaaccacacatacacatgcattgtcctcaaactgaagatctattgtgtcaagagttccgtctacacatgcctccatcacatcaatgatatcattcttcatacgaggaagcacaacctgtgcctcaggatctccgaatcttgcattgtactcaagcacctttggtccatcctctgtgagcatgagtccgaagaagataactcctgtaaaaggtctgccctctttagccatagcatctacagttgcctgataaatatacttcttgcagaaatcatcgacctcatcggtatagaacggactaggtgagaaattacccatgccgcctgtattaaggcctgtatcaccatcgcctgcacgcttgtgatcctgcgcagatgacataatcttgatagtctttccgtctacaaatgaaagcaccgaaacctcacggcctgtcatgaactcctcaactaccatggtgtttccggctgttccgaacttcttatcctccatgatggttctgacaccctcttttgcctcctcaagagtattacagataagcacaccctttccaagagcaagtccgtctgcctttaacacgatagggaactttgctgtctctaaatatttaagagcctctttggcatcagtaaaattctcatatgccgcagtagggatattatactttttcatgaggtcctttgaaaatgcctttgagccctcaagaatagctgcattcttctttggtccgaaacacttgagccctgccttttcaaactcgtcaacgataccacctacaagcggatcatccatgccgatgattgtaaaatcaatggcattatcctttgcaaatgatacgagcttatcaaattccatcgcaccgattggcacacactctgcaagtgcagcgatacctgcattgcccggtgcacagtatatcttgtcaacgcgtgagctctttgcaacagccctgcatattgcatgttctcttccgccgcttcctactactaataccttcatttttgcctcctatacctaagctatacataagcttttcattgtccggtaatcataatctacctgtgtttacatactaattacttacagcactgtcattacttctcatctataataacatgtccgtcttctactgacaccctgccatttgctatcaggtcgatagcgtgtggcatgattttccactcagcctgctccataaccctgcgctggagcacctcaggtgtgtcgccctgctttacctcgactgccttctgtaaaataatagggcctgtgtctgtgccttcatccacaaagtggcaggttgcacctgtcaccttcacaccgcgtgcaagcactccctcatgcaccttaagaccatagtagcctgtgccgcagaaagatggtatgagcgatggatggatatttatgattctgtttctgtactgctttatcatctcaggtggaatcactaccagaaaacctgccagtacgactaaatccacatgatatgaattaagctgctttaaaaaatcttcattgaaggcagctctgctttcatagctctttggcgagatgcatactgcctttattccagcctttttagctctctcaagtgcatatgcatctgcgttgttgctgataacaacctctatctgtgtgtttgtaattgttccgttatctattgcatctatgatggcctgaagattggtgccgccacccgatacacatactgcaattttcattctttttcctcgcaacgatgtatacaattattaacaatatattgaatgttattatacgagatctacacccttctcgccgtcaataatctttccgactacgtatggtgtatctccggcagacttcatagcctccatagtcttgtccacgtctgcagggtcaactgcgacaatcattccaagtcccatgttgtaggtattgtacatcatctgctcctcaacatttccctctctagccatcattttaaagattggtggaacagggtagctgtttttctcaattacggcacgcttgccatcaatgagcatacgtgggatattctcatagaagccgccgcctgtaatatgactgcaggcctttactgtgactcctgcgtcctttacagccttaagagcctttacatagattcttgtaggggcaagaagtgcctctccaagtgtagtgccaagctcctcatgatatgtatttaatgtctccttgtccatcttgaaaatctttctgacaagtgaaaatccatttgagtgtacgcctgttgatgccattccgataagtacatcaccatcctttaatccctcgcctgtgatgatgtcctttctgtcaaccacaccaactgcaaagcctgcaaggtcatactcgtcctcaggcataagacccggatgctctgctgtctcaccaccaacgagtgcacagcctgactgcttacagccctctgccacaccgcttacgattgtagcaatcttctccggatagttctttccacatgctatataatcaaggaaaaataatggctcaccgcctgcacatgccacatcatttacacacatggcaactgcatcgattccgattgtatcatgcttgtccatgatgaaagcaagctttaccttagttccgcagccatctgttccggataaaagcaccggatcctccatatccttgatggaagcaagtgagaacgctcctgagaagcctccgagaccacctaacacctccggtctcatagtctcctttacatgctttttcataagctctactgacttgtaacctgcctcgatatcaacacctgaattcttgtaatccattattgttcctcctaataatctgcaattcgttcaatacctatagtataccttcatagtgccaaattttccaattatatattgtaattattcttattagatttactaatataatatatcttttatagaaataatacttataatttatttcatggattatattgacatcagacatccatcgtcctacactatccatgcaaataaatatttagatttgaacgattaataatacaaaagaaagcaaggagaacaacaaatgcttaaacagataaaaaattttctgataatgacactcagtatcaccatcatggcaatcggtgtatactatttcaagttcccaaacaacttcaccttcggtggtgtaaccggtgccgcagttgtttttgcgaagataacacctctctcagcgagtatgttttctactattgtgaacatgcttctgcttgtagtgggctttttcttccttggcaaaggctttgctattaagaccacctatgccacaatacttttgtctgttgagcttctggtgcttgaaaagcttgacccgctcactcatccgctctcaaacgagccaatgcttgagctgatttttgccatcgctcttcctgcaatcgcatctgcactgcttttctatgtaggggcttcaagtggcggaaccgatgtcatcgccatgattgtaaaaaaatatgcacatgtagaaaatattggcatggctttatttctcaccgacctcgtcatgattatcatcgcctgctttgtatttgacataaaaaccgctctgtattcatttgtcggacttgttgtgaaatcatttatgattgatgcaatcatcgaaaatatcatgctcagaaaatccataatgcttatctgcgatgacaaggatgtgatatgcgattatattactaacacgctggagaaaagtgccacctatgtggaggcacgaggtgcttacaccggtgagagaaactatatcgttttcagcactcttacaaagaagcaggccatagagcttagaagcttcatacatcagaataagctgcatgcttttatgtctgtgatgagcaccagtgaagtatttggtaagggattttcttccctgtaaattcattagaaatcttcccttacctgtacttcaggctgtatccgtccttcttccataaaatcatctgaaaacatatccagactactaagcaatccagtccattcattatccttcgctaaaagaaaaaacataacagaacacctcctttttcatttagtctataatttcgaataagctgcatcgtttctggaaagaagatatacacaatactgattcatactgataccttccctcttagaatgttctgcaagggaacgatgaagacttcgtggaattctaagtttaaactgtccagaataatcctctaagctgtccggctcatggatttcaataccatcttccatagcagcttctaaccatgctttcttggcatctaaagcgtttgcgacagcggattctactgtttctccgcaggtaatacatcccggaagctccggaaatgaaaccacaaaaccgccctcatccttatcctctacaatttccatacgataattcattgcaaaataatcattcagcgttttcatcattcaccgcctcactttccaataccttacgcaattcatcaaaccggaggtcttttgataaagcacatattctcgttaatagtttatcccattttgacattctaaacacctcatgtctatattatacgtggtgtcgcatttggtgtctatgccgtttatcaaaaaagagagttgcatgatataaaccatttatgataatgtcctaatatacaacaaaacagccgtaaccacgatttatctttcatttgaccaatcgcagctacggctgttatatttacatgaactaatctatttcaaaaaccacagaatttattcatattcttgtctaaatgttgatagaaattttataacgtcattttcctctgattcagtaaattttccatcttctgcttctgctactaccgcataagtacctccataataattccatgagcactcttcatatacgcctccgcctcccttaaatgtggtcttacccaaataactttccggaacaaccgcgtaataagttggtccatcaaattcctgttcaccttcatcgctaagaccatcttctatagcaataaccttgatttttgcaacacaaaactttcccaaatcatcctcattgccttcagtttccatacgaaaatcacaatctgcaaccttatccacacttgcagtttctaaatcatatccacctccataatattgggaaaactgttccgcatagtgccaaaatataatttcggcacccttacgatcctctatcttttcctgtctatactctgtcccttcaccaatatctatatacttccagtttgctgagtaatcatacgcaaacagtattttaggtgcttcccttcttccaagagtataaaatgtttcaccaagttcagtattatcattttcattctcggtagccacttctgtctcttttgtgctgtatacattattttctgtatcaacacctgaatgagcttctgaagtattatttgaatttacttttgtgcttccacaggctgttaagagactgatgcatacaagcagcatagtaaatgataatttattttgatactttaaatgttgcagaaccatgacctattccttccattatttcatcatttaatttaataaaggctctaatatttgccttatccgttgataatactctttccggctttgaaatccactctccggcattaagattcagcatcaaagtttctttatctatcgttcccgaaaaactatagctgcccggctgtgtatatttgtctattctatcaggtgtatagctataagagcccgacaccgcatcaccatttacctctgaaatattaagagatactgttccactgcttccggcagccgtgtaatttccggtccactcacctgtaatatcaagattttctaattttgcgttagtctcaattgatggttcattccaaccgctactgtaggtaaatgttaattccatttccacaaaaaatgtcgcatattttttagttagtgttgcactgcatttaacagtctgtatggttcccttcgctcccgaagactgttcttttattttaaaattacttatatcagattctgtcataggtatttcctgagctgtagaatcacttattagcgaaactaaacctgaaccatttgacttattaccatatttaaaagattgttttgtaatatagtttaatattgatttttctgaggtatccagttttttgtcttctttgacttcagatgttacattagatgcatcggttacacctttaaaattccactctttatcaaaattatattcaacaatgatgcttccctttgctttttctactgctccatctaaagtgatatcaacagttattttatctcttttgtttttcaagtctgtttcctgcttggttattgataaatcactgatttcacctttttctatttcccattcctcatttttaagctttattacttcacctacaagatctgattctatgacttttttacttactcctttaagaggcgtaattttccactctgaatttatatttacttgaacgtttgccaactcccattccttagattttttatatattgcattcacctgtttttcatatgatatatcattcttttctgtctttactgtacaatatagcgtatatgaatcatcattactttcagaattatcaatttttaccgaatcaattttttccccgccagatttcaaattttcattttcaaaagtcttcaagtcttccgttacctttttttcatccggcttactagaacatcccgacagcataaatgccatacatacagttaataatattatctttccaaatatttttttcattttttatttcccctttttaatataaatgtgaataatagtccaatataggaactcttttttcaatcaacaaatttcccactgcttcctcaatatctgctctcttatacccttttggaatattttttaacggaaatatcaacacaaagtccctattccactcttttccaagcttatgaaccaatattcctgatgaattgtgaagccatgtctcttcatatttttttgagtaaggattgtatacgttgtgttttctatcatactcacgactactctgtgggatatcaaaattcacatcattacttgtagccacaacacccacatatccatcttttgtaaatttaatccataccaaatctctttcatcttccaaatcaaactctgcttttattctgctataatctaatttttgtggattaaatatcggattttctattgtccttattccaatttcattcaaaaaatctttaatatatttaattaccatatccacatcaacagtagcatatccagcctgctcttttgctttgttaaaacgaatataactctttccatgaacagactgcatatattgttttccattatactcgtaatacgcttccggaactctatataaatatttttccagtattttgttcatctcttttatctcctacaagcttgtatgttatcttacaatggtttcagactctttatgaccacaatatttacatatgtaccactgataataatataatttcgttacaggtacatccttttcatatgttccggtcacctcatgatttctattgtaaatattatattcttttctttctacaacattttccttacctaaaaactcccttttaccgggtttcatggcaaatattttcttacatgccggacatctatccatagatagcgcaaaccatacaccgcctcctccaattgctaaacatataataccagcaatcatcgatcccaatgcaccatttacaccaaccctatgcgataaaactaaattcgcaaaaaaatcaaatagcagcatcaataaaaaaaatgctcctataaggcctataaaaccaaaaaaaattagagctaacacctgtaaaaatcttttcataaatatacatctcctttgtaatttttattgattataccatattgtgaatatctccataatatttattttaataatacatcaatataatcaagctatcaaatataaggagatgataaatattattagctatgcaccattatggaaaacactagaaatgaagaacatttctcaatatcacttattaaaatcaggcttggataataaaactttagacggtttaaagaaaaacaaaaacataactttgctaaccgtagaaaaattatgcaatatcattgattgcactccaaatgatattgtagaatttaaatagataattgaaaacagccgtaaccgcgatttatctttcatctgatcaatcgcagctacggctgttatatttacatgaactaatttatttcaaaaactagtgcttcggaataagcttctctgtaccacccatgtatggctgaagtgccttagggatatttacagagccatctgcattcaggttgttctcaaggaatgcgatgagcatacgtggtggagcaacaactgtgttgttaagagtatgtgcaaagtatttcttgccatcctcgccctttacacgaatcttaagacgtcttgcctgtgcatcgcctaagttagagcagcttccaacctcgaagtacttcttctgtcttggtgaccatgcctctacgtcgcatgatttaaccttgagatctgcgaggtctcctgaacagcactcaagagtacggacaggcacatcgagacttctgaaaagctctactgtgtacttccacatcttctcataccattcctttgaatcctgtggcttgcagacaacaatcatctcctgcttctcaaactggtggatacggtaaacacctctctcctcaatgccgtgtgcacccttttccttacggaagcaaggtgagtagcttgtgagtgtgtatggaagctttgactcatcgtttattgtatcgatgaacttaccgatcattgagtgctcagatgtgccgataaggtagagatcctctccctcaatcttgtacatcatggcatccatctcctcaaagctcataacgcctgttacgacatttgaacggatcatgaatggtgggatacagtatgtaaagccctttccaatcatgaagtcacgcgcatatgctgtcatggctgagtgaagacgtgcgatatctcccatcagataatagaaaccgtttcctgcaacctttcctgctgcatcgaggtctattccgtcaaatctctccatgatatctgtatgataaggaatctcgaaatcaggaacaacaggctcaccaaacttctcgttctccacgttgaaggtatcatcctttccgattggaactgatggatcgatgatgtttggaatcttcatcatatcctcaagcaccttgtcctgatactctttctcgagtggctcaagctctgtgaggcgctttgaaatctgtgctacctcagcctttacagcctcagcctcttccttcttgccctgtgccataagagcaccaatctgcttagaaacctgattcttctttgcacgaagatcatctgcctcctgctgtgcttctctggctttcttgtcatactcgattacttcatcgacgagcggaagcttgtggtcctggaatttctttttaatattttcttttacgagatccggattctctcttaaaaactttaagtctatcataattcctccaaagtattatgtttttataacttataacattttactctgaaaacccttaaaatgcaagaggatacttgtcagtaagtgtcttgatgatagcctttgcaggctcaactgcgctctcaccctctttgatgatcatggcgattgcctctgcaaccttgtcgaaatcatcctcctttaagcctcttgatgtggcagcaggtgttccgagacggataccgcttgtgacaaatggcttctgtgggtcgttaggaatagtattcttgttggctgtgatatgagctgcatcaagaagcttctcgatagactttccagtaagaccaaacggagttaagtctacgagcatgaggtggttgtctgtgccgtctgatacaatcttgatgccacggctctgaagacccttgcaaagtgcctgtgcgttctttacaatctgcttctgatactccttgaactcaggctgtaatgcctccttgaagcagactgcctttgcagcgataacatgcatgagaggtccaccctggattccagggaaaatagccttgttgaaattgtacttatcctgcatctcctgactgcagagaatcattcctccacgaggtccacggagagtcttgtgtgtagtggttgtggtaacatgtgcatatgggattgggcttggatgaagtcctgctgctacaagacctgcgatatgagccatatcaaccatgagcactgcgtctaccttgtctgcaatctctctgaaacgcttgaaatctatagttctcgcatatgcagatgcacctgcgatgatcatctttggcttgcactcaagggcaatctcctctaccttgtcatagtcgatgaagccctcgtcatttactccgtaaggcactacatggaaatatgagcctgagaagttgaccggtgaaccatgtgtgaggtgtccgccatggtcaagattcattcccatgatggtatcgcccggctttaagatggcgaactgaactgccatgttggcctgtgcgcctgagtgtggctgtacatttacatactctgcgccgaaaagctccttggctctttctctggcaagctcctctacctcgtccacgcactcgcagccgccgtagtatcttcttcccggatatccctcagcgtacttattagtgagaatgcttcccatggctgacataacagcagggcttacccagttctcagaagcaataagctcgatatggctgttctggcgctcaaactcgtctgtgattgcgcttgcaatctcctgatcttctttcttgatgtcgtcaagtgtatacatatatgtgtctccttttctttattgcaaaatgcttgcattatttgtcgcaattatatgctttgctgtgatttattactttgatacgctaccgcacaaaaataatccttgctacaattctactatttaaagcagaaagtggcaaggattatttgatatatccttcatatttaattcttataagtaactatacccaaatcaaataactaaaatcacatatatgaatacatttaaaaaatacggtcatcctataaaaaaggaggtctgaaaacatgactactgaccaaaaagaaaaacgaaatgatgaatataacaaatatgtaaagcgcgtcacacctactcactgcctttctgcaaacatgctaaaggcatttatactcggcggaatcatatgcactatcggacagctcatagtaaacaccggcacgcaatactttgggttaagcaatgatgaagcctcagcatggtgcagcatgattttgattctcataagctgcgtgctgacatcgctaaacctgtatgcaccacttgcaaactggggaggcgcaggcgctctcgttcctataacaggctttgcaaacggagtatgctcgtccgcctgtgaattccaggtggagggacaggtatttggcataggctgtcagatatttaggattgccggtcctgtgatactgtacggcatattttcaagctgggggcttggtgtgatataccttgtcgtaacaaacttttgattgtttagcgttttcagctactcagtcacttattttttccttgtcagaagaaaagacataataagcgatgtaatcggcacagtcaggataattcccattgtgcctgatatgcctcgcattatctcgattgccatagaatacatattaagtatctggtgcatctgatacgagtatgcatatatgatcatcacaagcccgaggcttcctcccacataggcaagaatcagcgtatttgacatagttccaatcatatctcggcctatatttatacccgacctaaatatctcctttgcagatatatccgggctcttttcttttatctcgtgaagtgatgtggctacagacatcgccacatccatcacagctccaagtgatgcgatgagtatgccggaaaacagcatgccgctgatatcgagctttgagttctgtccaacataaatcagattttcaatatcatccacattgtagcccgtcacatgtccgaagtgtccaaaaagcaatgctattattccggagaccacaactccaaaaacagttccaagcatggcacctatggatttcatctgccagtccgctataagtgtgaacgtgacaaccgtgataatgacaaccgaagcagttgccgcaataaacggagatgctccgatatacatgagcggaatatacaaaaatataacagttgcaaaggtaaatataagcgcaagaatggaattaaagcccttctttccgccaaccagccacataagtccaaaaaatgccgctagaagcacccatatctcattttccctgtcgtagttataaacattagctgacagactgccatcatattccgacaggctcgcaataacccttgtgcctaccttacaattggcaccgtataaatatccgtttaagctgtatgcatcaactgtctcccccttgtggcttcctgacttgataagcaaaacaaccttctggctgtcgccactgtctagtgatgcttcagcctgaaggtcttcattgtcgttttgcgtaaccaccgccctcacaaacgacgtattgtcatctgcaagaagcggttttctttcaacacttcgaaagaatataaacattgccagtgtaataagagccacaatcaggtatttgccaaatgtgtcaattatttttgccaaaatttacccttctttctcattccaagcactgctgcaaggattgctgcacctaatactccaagtgctgcatatatgccgccatggttaacatctcctgtctttaccttagcgctctttgaagtacttgcgctattagaagccgacttgcctgtacctgaatttgatgtgctgacattctggtttcctgagccgcctgcattatttcctgcaacctgctgacctgtgcttccgttctgacctgcgttgccctgtgctccgtttccgttctgatttgcaccaccctgtgctccgtttccactctggtctgcatttccgttctgatttccacttggagcagtctgtttaacctgtaaagcatttattgcatttacaactgctttctttgcctcatcaataccctttacaaccggagccttatcagcactataatcagaaaggttttcctcactgccttcagctacctgagtatagattgtcttgtcaagaagtgtagaaattcccttcttgaaacgattttttgcaccatctttatcatcattctttgctatagagccatatcccttaacacggtcatttgctgttccataatttgttgtgatatcacttatcatcggatcatctgctgttgtgccggatgccttaagctccttaagagaggcaagtgctgattttaatgtttccatgctctcatctgtgtatgctacgtctgtgctgtttacaagagcatctgctgccgcaatcacctcatcggcactctgcgcatctgttgtctttgtgattgtgaaatcatcagcatatttatttccgttgtagtcatatgtctttattgtcattgctccacttgaaaaatctatagtagagaatgaaggcagacaagcattggttctctctgcgatataatatggagtgtaatttaacagattatagtattttgaacctgagcctgagcctgttgtaatataaagagttccctccgaattgttaaccgaacctttgctcaaatcatagtcgataacatttccgtcctgtacctggtagcttcttgaatatgtatgatcatgacctgtaagacacacatcgatatcaaactcgtccatgagcggtgcaaagataattctgtttgtagtagcatctgtatctgcatgtggctgtcctgagccatagatatcactatgaaataccactaccttccatgctgcatccggattgcttgcaacagcctttttcataaactctctgtgctctgcctggttacgattattactgtttaaagaaatgaacaatacatttccattattgaagtagaaatcacagccggcaccggtgcttcccagattatcctctgagttcggattgttgaaatgtgcagtgtagtcagagccgtccttatcatggtttccgattgtggctgcaataggaagacttctgaatactgacggataaagatatcctgcatactcactctctctggtcttcttcgtctcttccgatcctgcatttgactcatttatctggtctccggccgataaaagaaatgacgcatccggatcaatctccatagccttctgcattgtcttgttccagttgtaggcatcctgtgcaacactcatatcgtttgcctctttatcacttttactgccggatgctccaatctgaggatctcctgtcaggattacagaaaatgtatctgtagcgtgtgtggtgtatgtatactcatctgaccatactgtatcgctattgtccgaataattgtctgtatactgataaacatactttgtatttggttcaaaaaagccattgatgcttactttatttgaagcagcataggcttcttgctgccagtttgtggcacttatatctgttgcagtaccctttacaatctgtgcacctgcctttgagccatccttccataccatcacagccggtgtgcccttggtctttgaataccatgcaaagcccagatccttggctgtagagcccggtgtaagcgcaatctgattggtattggcaaagtcctgtgtgccaccctgccatgtaccggttaaccagctctgataatctgctgaacctgttgttgccgcattaaaagccgcctgacctgtttttgaatctgcttcaccataagcataagccggaattgccggtgccatggtaactaccattgttgaaactgctgcaaggatcatgcccttcttcagtatgttcttgttctttctcatattttcctccacaaaattaagttagtgtgtttcacagctgctgaaattactataacttaaagttgtaaagtcgaaaggtgtgtggaggtaaattgggtgtaaagattaaatatatctaataactgatttttttttgctcaaaatcatttctttcttatttttatagcatcttctatttcttctttagtcaattccaccacaatatctgctatcagatcgaccgaatatccctcttcatacatgttaaaaaccatttgtttacgcatttctttttcaaagccctttttataccctctcaggaagccctctgcatacgcatcggctctctcgagctcaagttgtctgtcgaattcataatttaataatgccatgtttaaacttataatcaaatttattgattatctttcccctttttatatacttcttccatatattctataaactcaactctttcaggattctcatatcctctaaatacaacatcatttacatcagaatgattaaacaaaaaattgaactcatcatttaggtaaccttccggatatattactcctatatagtcatattcttgttctgtgccatcatcatcatcttttgatactggtttaataccagtaaccattatttttttaattccaccttttaataacactacacttccaatcggcaataattctttaaacatgtctacctccattatccttacattacataccatatgctttattcaattcatcataaacagtccaaactgtctgtgcagctttacctgctttttctgccactttacaaaaacctgatactactttttttcctacaagttcagctgcgccacatcccgcagctaatcctcgcaatactataggattattcttatttccaatatattgaacaagcttactattactgttaaccatatttgtaacatcatcttcaagttctttagctgttttatcaccatcgaaagatacaactccaaaagtcactgaacttgccaacttactcagaccatttgttgcagaataaatacctacagacgcaccatccacaatatcaacttttccatctttggatacctgtccataacgcttcactccactagaaactgcactaacacctgcatcaaatatatcaatatatgtactcgccgttgaaattttctttccaactgttgcagcagttgtgtattttaatgatgattcagttgctaaaatctgattttttactcctttagaacagtcttctaagttattcactattcgtaaagattttgtaccagacatttttgcaatttttagttttccataaaaatcagctaatgaacctcctacattaatcgcctgaccaactttgtcatatgcgttactattttcatcaaccattacatcatgcatttttacactattctcaccaatttcagcaacactcgaaattgcagacagtacaatatttccttttccatatttttcacctaattttgaggcttcatatggtgtcaagtcaaactatcaatttgtccattcatttttctagtacatgatttatataacttgagtgagtttgctgtttttccctccttaattgcagaacgaatgacttcatcaagaattttttgatattccgtaaatatatcctccagttcagccgcacattccgaattaaacttcacaacttcattgatataattctcgtcaaatttcaaattactcatgaacgttcctcctaacaaaactatttaccaacataacgcatttgattattcaaataatctatattacaagagaatctttttatcgaactataattattactgatttgattctgtaattttcttatctgactattaaccttatcaatagacctgtatatctcattacatgctttcctatactcacttccatttactaccccatgcatggcagaagtatatgaacttacaatttttgaattaatatatgacatattatttatatctgaaattctagcgttttgcatattatgtttataattaaaatcataaagcaatctattaaaactattcctgagtccttcaagattttcaatctgtgactcctgctcatttatagtggttcgaatatttccaatttgattctgattgtaaatgagctttttccttatatcatctctcgtcatctcgcacaccctctctcaagaagttgtaatggtactttattcttatttcattttgtcactatttttatcttttgttaatactatatttacacacagtaaatatagatagcatttaatatacgctaaaatagccggcacaaaagtgccggctattttagcgtacttaataattctattttacaattgaaaaggtcaaacgactaaagcattccttagcagatttttctgaaacattgtttccaattaaaatacctgttttagaatctttgaggtgaattgcataatcatattcctcatcattgttattccacatgatatactcgtatgtttcattatctcctttgtcaataacggttgctgtgtctgtgtcattaaccacactgacatatgaatcataatcatcagctgtaataaaagtaccctggctcaaggttttattatcctttgatataacaaatggtaaatcagaggtaatatcatatccatctgctgtattcagctcaacctttacctgatcccctgtatcaaccttgaatgtatatgcttttgacgaattagtagaacaagcacaacagccaattacaactcctacaattaacaccatacaactaagcttctttaataaatttttcattttttattctccttttaactctctaatttttgtatctgccatttgtttaaatgccatctgttcttcatcttgatatcccaaagcatatacatgtgaaatttactcacgattgaataaaaacattttctctgcatctaaatatccctccggaaagataacgccgtatagtcccatattgcattaggatcctgaccacctttctgacagacaccaacaatcataactttctttttactatttccaattaagactacacttccaataggtaattattcataatatatcctagattaattttttaccataaaaatacatataacaataattaccaatataccaaacgatgccaataatctcaaatcacctgacaaatcatccttgcaaggaacaatattttcatctaaaatttcaaccaatctatttcttcctttgggtgtttcccaataattcacagaaacttttttcccattaggtaaactttttgttttagatgaataatgaatagattgtgcttttactatattaccatttaattcaacattcacaatatacataacatttcctccatcactataaattgtttgatctatgactcctgttgtacttattttatccatgaactatttaaaccagtttgttgcggttttccctcctttctctaatccattccatgcagactcggcagcatcacaaacagtatctaccatacctccaatatctacctctgatcctacagaaccccccaatccaatagaagctcctatatcaaatttgaatactccatctttgtaacccacatccgcatgtgcacctactccaacacttacacttccactaacaccaacttcacctccaagtacatttactcctaatgagccttccagctcagccgcggtggcttcagcttttgcactagctccgaattgaggtttaagttttccatcttcaccatataactgaacaccaatatctgctttggctccagcatccccagccttaactgttagtagacagtccttcttttttattttaaattttgccactttaattactatgtgtcaacattttctttactaacagttaatattttcataatatatacacatacttattttatactttatcttttcagttatcatatttttgtttactcccaataaatctactgttctaaaatcctaatacaatttcatatattataaattaattttgggaagttttatgaatagttacaacattgacgctcaggcgctgggtgagcgcatccgcaaattacggcttaagaagaataagacacaggcctattttgctgatattctttacatatcaccatcatatttagcattaattgaagccggcaagcgagttccaaatttggatgttcttgttcatatagctgaaatcactgatgtttccatcgattacttgattttcggtgataacaaagaaccaaattcactacagctcacattagaaagactaaacaaatcgtatcccaaacgcaatgtagaacatgcccttatgcttgccgaatactatttgaaactcgaaaaaggacttttcgataccaaaaattctacaaattgatatttttttccattgccaattcccttccttatttttataatattcacataccatatattcaaatgcagcatataaagaaaggggattttcaatggacactttttcagaagtttttaaggctatcgcaagctacccgtggcaggtaaatgtgggtgtgctttcactaataccactgtacatcatagattttaagtttttctgcaaactaaatattggtttacagcgcaagatagcacttgcaaaggagcgcggacatgtggcgagaggcatgattgtgaaggaggatgcaaagaggctcgttgtcaataattcacaatccgcttacagctactgggctgccagatacacatatactgtagacggaaaggagtaccgcaagcgtttttcatgcgataacagacatagcacccgttctgagcttaggactatcataaatgtgtactggcttgatgacccgaacaagcctttctgggactacagcagcgattcactcggcgcatggtttggaatttttacgatattgtttccatggattggggctatacttatcatacagctgttaggcggtgccgatgcaatagcgcagtacaataacagtcggatgtgatactttcctacacaaaaaatccgctataccaaatacaatggttagcggatttttgtaaacgtcaaaccacgcgccttggataattagcatttttgtgagacactctataagacacgaaaaaactaatagttttttagaggaggcaaactatcatggataaatgtactcacgatgtaaggcgtgctaactggttaaatatcataaatcaatgtcaggaacgacctgcaaacgtaactgtccatcaatggctgaaagacaatgatatcaaggaaaaatcttattattactggctgcgcaagtttcgtaaagaatcatacgaccagatgcagctgcctgtaacaaccgaaaatcctgccgaaatttcttttgttgaaatagctgcccctgttacatcagagaaaactattcaaacacgggaattttcgtcagcttctaacgcgactgcagttgtcaggaatggtgatatcattctcgaaatatcaaacgatgtttcagatgctgtgctaagcaggctcttaaaggaggtagtccatgctggagaacgttgctaaaatcaatcgggttgtgcttgcgtgtggtacagtggatctgcgcaaaggcattgatggtctctcgatgatcattggtgacaaatataagcagaatccttttgagaaaggaaccttgttcctgttctgcggtagacgttccgacaggattaaaggactgctttggatgggcgatggatttcttttgctgtataaacggattgaatccggttcactatcctggccaagaaccacggaagacgctgcggatcttaccgaagagcaattcgattacctgatgctcggtttaaatccgctcgatcctaaaatcaaggatgtaacaccacaaaatcccttctgagtttgtgcaaaacagagatttttcaaagacatttatgacgtcaaaaaatctatagttgaacctggtttatatgcctttttcacaactggtacaatggttagcagttacttgaaacaaatatcttgaaatttgaaagctctatatttccctgcgtttatcagcatcctatagccttatagcgataggcataatgacggagagctaacacacaagaattcgctaattaaagctgcttctgttataatgaaaacagtttaagggagtgaagcaatggcacagaaacatacattggaagaactgaataattgcagccgcgaagaactgattaccattgttcttatgatgcagggacagctcgatgctttaaatgataacatcgaaaaactcattgagcaggtccgcattgccaataattatagatttggcaggcatacagagagcttaaaatcaatcgaaggccagctttcgttttttgacgaagcggacgccgcctatgatgaatcttccagggagccttctgctgaagaggtcattactgccaagcgtgcaaagaaaaaaggacagcggaatatcgacctgaaagatttcccggaagaaatacttccgccatacagtgtttctgaagaacagctggatgctttttatggaaaaggcaattggcgccgtatgccggatgaaacctacaagaggcttcgtcatgagcccgaagcatggactgtcgaaattcatactgtcgaggtgtatgtgggaactgatggtgatcatcaggatgagttccttcgtggaaacagacccaaggacttgcttcgcaacagtatagtgacgccatcattactggcatcaatacttaatgtaaaatatgtgaattcatcagcattacaccggattgagcaggagtttcaacgtaatggcgtaaatatatcacgccagacaatgtccaactggattgtcagatgctcccagatgtacttcactccgtttgttgaacggatgaagcaggagctgctgtcactgcatgtcacacagtcagatgaaacaccgactcaagtaatagcagacagcgaccacccaaacagcaagtgctatatgtgggtgcaccgttccggagagttttatacccgacgcccgattgtgatatatgagtaccaaaaaggacgtgatcatcaaaagcctctggatttttacaaggattacaaaggaatccttgtaacggacagcctgcagcaatatcatctagttgataaaaagcttccagatgtgacaaacgcaaactgctgggcgcatgcaaggcgtgattttgcggatgcggttaaggctgccgataaaaaggatccgtcttctgtaaggcagtctgttgcctatcaggcattgcagaagatagccgggttttataatgctgacactgagttaaaagggctctcatcagaggaacggcttcaaaaacggcaggaattgatccggccgctggttgaggaattttttgcgtgggtaaaacaacaggttaacgactgtgcggtacctccaaaatccaaaacaggccaggggctgaatttcataatcaatcaggaaaaatatcttaaggtatttcttgaagatggagatgtccctatcgataattctgcctcggagagagccatacgcaccttttgcctcggcaagaaaaactggatgttccacaatacagccaaaggagcatctgccagtgcgatggtatacagtatttcagaaacagccaagctgaataatctgcggccgtattattattttaaatatatcctcacagaactgccaaaactctgtgaggaaaaagaaaatatagatccagaaaagctggactatctcatgccatggtcagatagtcttccggacgaatgcaggaagccacgtcgccaataatgggcggcgttgattttaatgactggcgcatggtttgacgtttacggatttttactgtttacattttgataaattattcatacctgatgctacacagtctcaggtaccttatagcctgcttcactcatcaatttttcaaactcactgacactgacaccggcttcctctgctgcagtatcaatatcgagcttgccctttgttaccagagtaaacaacatcttattttctcctcgtattatatagtagtagtttttatagaccctctccaaggtctttacaactattaggtcatagtccattctttacctcttctgtaggttcgactatgatatataagatgctgtggattggttttatttctcctaccacttgatggttttaggaaggctccaaccacagtctctttgttcatttgttaatcagttagataccgcatgacggtttatttagaacgaggttacaatcgcaaggagcaccctgtggttctaaaacagcattaatacatttcaaaggagatttattatgatttacataggaattgatgttgcaaaggataagcatgattgctttatcaccaactctgatagcgaagtgttgtttaaagcatttaccatcttcaacaacttagatggttttaatgatctttatcaaaagattgaatccgttatggatgatgtgacaaaagtaaaagtaggactggaagccactggacactatagttacaatctccttggatatctcattgataaaggtctgcccacctatgttatcaatccgttacatacaaatctgtacagaaaaagtctaagccttagacagacaaaaacggataaagtagatgcccgcacgattgcttccatgctcatgtctgatgtgaacttaaagtcctactcagacacatcttaccacaacgaagagttaaagtcattaactcgttatcgttttgataaagtaaaagaacgtgccaagctaaaaacttccgtttcaagactagtctgtatcttattccctgaattagaaaaacttgtaccaacacttcatatggcatctgtttatgcattgctttctgaatttcccagtgctaaacatgtagctactgcacaccttaccagacttacaaatcttctttccgaatcttccaaaggtcgatatggtaaagatactgctattactttcagagattctgcaagagcttctatcggctcaaatatgccagccaaatctcttgaattgaagcacaccatcaaacttattcaggaacttgattcagagattgatgaaatcgaaaatgagattaaaatcatcatggatgaaatcaactctccaattcttagcattcctggaatcaactatcgcatgggagctatgattattgccgagatcggtgatttcaatcgttttgattctcctgataagatcttagcttatgccggcttttcgccatcaacatatcaatccggacaactggatggtgcctacgcacatatggaaaaacgtggctccagatatctgcgatacgctttgtataatgccaccaaatatgtctgccactgggatccaacatttgcagcctatcttgctaaaaaacgagcggaaggtaaacattacaatgttgccatatcacacgctgtaaagaaattggttcgagtgatttatcatcttgaaaaaacaaagcagcaatacataaaagcagcttaaatctttctaattcaatactccttttttgagcacctatcacgatgctctttttgtcatacagttttcaaggttcaaggaactctaactgagttccaaatatatctaaaatacatttctgtactttattcaaaaaatatcattttaaggcttgacttttaatagttagtcttcctcgatagcatcagctctttcaagctcaagctgcctgtcaaattcataatttaactgcatactcttcgtcacctcacttctgtaagtctttaaaaactccttcagaatatcattgtcaatacaatagtctatagccttctcaatatctatagcaagatcatcaaatgccccgtctgcatgatactctctgaccttatttacaaatgtcatataatcattcagccagccacaggactccataatagccttgttctttccgtcgtttatattgtacaccttacatttaagctcaagattcggctcgtcggtcggcttctcaaacgcatcggatagcttaagctcctgaacctccggctgttcctcctcaccattgtaaaataccacaaagtgtggtgtcggtatctttaccagtcttctgccatagatgttcttgcccttttttgttccttttttcttgtcgctgagcatatctgacaatatcacactaaaataaataagacttctcaccggcatattaggacaaactgtggactgatgctcatatatgctcaatctcgcatccacgataaacgatgcatcatttctgaccgaaagtgaaatgccgccatcgtgaatcaccatctcaacatcctccggattgtcatagctagacccattcattgcgttatacagctgtaaggctctttccttatcctgcatcaacatactgaaaacatcacttttatactctctgttaccactcatataaaatcctccttcatttgaaaacactaaagcaggaaatatctgtgtagtaaaagccctcttatcctgctttaaataaaataatgaaacatttaaaagcaagaatttcagggaatatgaaaaataattaaggtattgaagaccctgcacgcccttatcgccggacgacatcttattatgcctcacatatttacagagcatatagtcatatctgtaataaatgtgccaacgaccgcacaggttgctatagaaaaactgctttgactatattttaacatatgtgaaagaaatagcaagcggtttgtattttattatattgtttttgttgtatatgcaacatatttttggacaaaattatagtaatattgtattataaataatgaaatcaacattcaagaaagaaggacaagaaatcctatggacaaggttttcaaaatagaagatttacgccctatccgcgacgagatgaccatctcacgaaattcaaggctaagtgacaaaacacccataacctatttttctctcggaaaaggcacgtcaatctctcaggaatcctacgataataccactgtatacatcggtgcaaaaggatgcgctgattttcttatcggagattatgctgcaaaacataccatatcagaaggtgatatgctggtagtcccttcgaaaacactctgcggagtaacaacagaaaccggctgtatttacatcgaaatcatcataaaaaaggagaacaacaatatgaacaaaattatcaaatcaggcgaggtcatgaagcttaaggatcttatctcatatgaggatggcagtatcactaacattgatgtggtaagcaacgacacaatgaaattcgtgcttatggcattcgatgagggcaccggtctcacaccgcatcgcgctcctggaaatgcaataattttcgcactcgagggcaaggctgtaatagattacgaaggcaaagattacacaatctcagcaggcgaaaatttccgttttgacaaaaacggactgcacagcgtaaccgctgacggaaggttcaagatgggactgcttctggtgttggagtaaagcacattaaaaagcacaaaaaatccgctatacccaatacaatggttagcggatttttgctatttacattttgataaattattcatgcctgatgctacacagtctccggcaccttatagcctgcttcattcattaatttttcaaactcactgacactgacaccggcttcctctgctgcagtatcaatatcgagcttgccctttgttaccagagtaaacaacatcttattctccccctgttgtattccaagctttttatgatcttcccatgccttacacacattaatcacctcttccttttcttcatactcaatatctgttcctgcaaacaaattcattgctgctattgtctcaacatcgacttttttaaaaatatcatctgtcgtgattaaatcatttagttttctttcatctgatgcattttttaacacctcaaataatggtcttagaccagtctcaaacattgaaaaatctgtcagctcaagtggattcaacagattaattttataatcgtttataagtggaaatattctctcatccatctgtggcatcatttcaatcagacttcttggtccatcccactttgatgtaccaagatataatgttatggttatcaccggagtcagtttgtcatcttgcgtgaatcctgacaaaaattcctctgatgatttataatccttgttcttctgatgtcgcttctttgcttcattgacctggtcaccataattcaatgcatcatacatcatggtttttacaggcatagcatagtgcacatcagtctgtgcttctatgcctatcaatacaatatacatgtttcctgtatatttgactgaaacactcttaagcaagtctctccatttctgcctgataatctgtttcctgtcaattccaaatatagataatacctctgtggaatcacattccttcaaatcctgcggtttgataattttggctccgccaaacaacatgtagttgcagatttcactaaacctgcgattgtctgacagatactctttggcttttgaatcttttacgcccaattttcttctcctattcacttgtgtgagcaggaaatggcatcaaatgagaattgtaatttacctacaatctgcatacattctacgtacccctacatataaatatggcattattctacacctgacatattattttcctgctatttactggtatcttaaagcatcgaaaatttccatgtcctttgtagaatgatgcgaagtggtctgccctcttcaaagtgatacgcaccaattattgacgtgttatgtggtgacgctctacagaaatataatgctttgactaaattgtaacatagggatattcttttgtcattatgaaaataaatgtattttataatttttaggtaacgattcagaaccctatcggttgaaaaaatctatgatgctacacagtctcaggcaccttatagcctgcttctctcattaatttttcaaactcactgaaaccggctgcttcctaagcaccggcattgtgtatatcttcaccaaaagcggtatcaccatgataaaccatactatcggctctgccactatcactcctgtatagccaagcagtggcacaagtgtgaatgcaatgacaatctttcctaccatctcaagtgagcttgatacaagcggcgtaactgtatcgcccagtgccctaagtgccgccgcacatgcatcatacaaaaatgtcgctacaagccctgctattataataaaaatatatgacacagccattcccatcaaaaatcctatcatcagattgctgagtgtcgtggtggctccgactgctgccagtgagttttctcccagatatgatccgactattctcgtgtcaactatactgtatgtgagctggagtatatttgccataaatattggaatggcaaatgccagtatgagtcttgatggttttccttttgtaaggtctttcatgtatgtatatcctcgtatatttcaaaatattttcatcaatatattagcagataaattttaaaattcaatctttttaatcggtaatataatcatttctaatcatactaaaatataaacaacaatatatagtttatatacgcaataattatacatattaaatttatatatattatatttacacgcattgaatttatacgtatcatatgttatattatatatatactaaagaaaggtggataaaaatatgccgatcaaaccaactgaaatggaacgtataatacttgccgatgggtggattttcaaaaaccaaaccggatcacatcggcattatattcatccttcaaagcccggaaaagtaactattccttttcataaaggcaaagaactgaacaaaatcactgaaaattctatccgtaagcaagcgggaatcaaataatcataaggaggtatactcatcatgttatcaatatatccggcatgtttttttaaggaagataatggatactctgtaatctttcctgatttaaattatcttgcaacacaaggagatacccttgaagatgctgtggccatggctgttgattgtcttgcaggatatctgtatacggctaagatggataatgaaaaatttcctaaagcatccaaattatctgatatcaatattgacagactatctgacgaattagacataacaggaacatataccgatgcatttaccaatatggtttcagtagatgttaaggcatatgccaaagagcatttcgataaatcggtccgaaaaacccttaccattccggcttggctaaatactgctgcgcaggaagagggaattaatttttcaaaaacactgcaggaagcacttatgtcaaagcttaaggctcattagatatctgcattataattcggagacattatgaacaacgatataaaatacaagctggccaatgccatgaaggaatgcatgttttcctctcctgtcgagaaaattacggttaaggaaatctgcgacacatgtggtgtgaccagacaaaccttttacagaaattttcaggacaaatatgacctgataaactggtattttgataagatactgattgaatccttccaccagatgggtgagggcagtaccgtgtacgaaagccttgttaaaaaatttgaatatatccggatggagcaacttttctttaaggctgcttttaaaaatgatgagcagaacaatctaaaggagcatgattttgagctgattcgtcagttttacattgaccagattgagggaaaaagccaccggaaaatatccgacaagctattgtttcagcttgagatgtactgtcagggctctgtctttatgacaacacagtgggtgcttggcaataaaaacttcacccctcaggagcttgccggactgctcgctgatgctatgccaaaggagcttgccgacgtatttcgcgaggtaaacctgatataattcaagtaaaatatgtggttttcgccaccaatttataacagagtaaaaatccgggaatgctgtcaattgacagttcccggatttttacatccctgtaagctgttgcagaattacataatcttacggaaaagagccttcaaatcctcaacacttgcatcctttggatttccaggtgcacatgcatccgcgtgagcagactctgcgaggaagtctaagtcatcctccttaatagcttcaagctttgttgggattcctacatctacagagagctgcgctacagcatcgattgcagcctttctgtactcctctacagacatatcatctacgccctttactcccattgcgcgggcgatttcacgatatttttcgcctgtgcagtctgcattgtactccattacgattggaagcatcatagcacatgctactccgtgtggtgtatcataaacagctccgagtgtatgagccattgaatgagcgattccaagacctacatttgagaatcccattccggcaatgtactctccaagtgccatgccctcacgtccctctttttcattggcaactgcacttcttaaggatcttgcaataatctctattgctttgagatggaacatgtctgtcatctcccaggcagcctttgttgtgtagccctcgatagcatgtgtgagtgcgtccatacctgttgatgctgtaagtccctttggcattgatgacatcatgtccgggtctacgattgcgatgattggcatgtcatgtgggtccacacatacaaactttctctttctctctacatctgtgatgacatagttgattgtaacctctgctgctgttcctgctgttgtaggtactgcaatgataggaacacaaggcttctttgtaggtgcaaccccctctaagcttcttacatcctcaaactccgggtttgcgatgatgataccgattgcctttgatgtatccatagaagagccgcctccgattgcaatgaggtaatcagctcctgatttcttaaatgtctctacgccatgctttacgttgtcgattgttggatttggcttaatctctgagtaaagctcatattccaatccgttcttatcaaggatatctgttacctttgctgtaactccaaatttgattaagtcagggtcagagcataccagtgcttttttaaagccatgcgcttttgcctctgttgcaatctcctggattgcacctgatccgtgataagatgtctcgtttaacatgattctgttagccatagtgtaaaatctccttccaattttaaaaatactcctaaaagactctgccgataaattcttataacttatctgcctgactatattttaacaaagtattaaacgagatgtaagttacaaacctgccaatgtgtaacatacctgttgcaatatgtaacctgccagttacctatgtatatcccaccgactgccaatcacaccttatggctgtctgatataactttctttaactctcttgccgccgcactaatcggttgatgtatatcatataccatacatatatttctctgcggtatctcctcctccagagctatctctacaatctcgcgatttgctatcgcagcctctgccataggctttggcataaaggcaagaccaagctcacttttcacaagtggcagtatctgatctgtcgttgcggtctctgtatcaggcgcaaattcaagtccgtgtgacataaaaagcctgttaaaaaactgaaatgtcatggtctcccgccccagtccgataagtggataattatgcagctcctttaatgacagagtctggcttccgagtgcagtaaaggtggttccacccacaagaatctcctgaaacgaaccaagctttatcatcttaagaggggcctccacctcagccggtgtcgataccactgcaaaatcaatcatgccgttttttacggcatttatagcctgtggggtggagtgattatatatcttaagcctgatacccggatatgccatgtgaaaaggttttagcctgtcaagcagatatatgtttagagctgtctcactggctcctattgatacgcttccgtgtgacagtcctgtgctgtctgacagctcctcctccgcagcaagtatctgtgacatcgctgcagatacatgcgcgtacagacgctcgccctccggtgtgagctgcacacctctgttatttctgataaaaagtatgctgtttatctgctgctccaaattgttcatggcgcgggttacatttggctggctgtttccaagtgccctcgcagcttttgtgaaattacagtattttgcaacataataaaatatcttgtagtactcaaaatttatatccatatttaaagcctcctttttattatcgttttaccggtcatttttccggtaatacacagatactaatgatataataatatgatatttcaattatatcaattatactttttacttattataatcataattgtataatcataaatgctcaaaagagaaatattgattatatatataagaaaaggacgtgtttcaaatgagtgaaaagacaatgtttccaagagaagaccatacagaaatgctgtttcagaagatactaaacgatccatgggcgtgtgacaggcttatggaaaccttcaatgaaaatctggtttacaacgatgaatttgatgtatcacttccggcagaaaaatttgctaaagctctcttcaatgcatataccaaccgcgatctttccgcactgcttatgtgtctgtgcaacaacaccgtatttgatttgctgcgcaattcatatatcataccgtacaggttcaatgccgacggacatcaaaatccgataatcatgaccgatgagcacggaaatccgctgcccgagtataaacacatatctcacgacaagaactatatacattttcatgagatatacaatgatatgccagacaaaaaggatatctactacgcacaggcttaccgctacagtcacacatatgattccgagcatatgactcccacgcagcaggtcattgtaaagcatgacggaatactcttgatacgagagcttcccgataccgtaaaactcaaggagactgaggctgaggcttactctgccgtatgggatctgatgatacagattgaaaaggagcttcctatggcatatgttttttacggtcaggactctcttgtggaaaatgacaagcggtatgatgaaattggtattttcctgcgaagctctcatttcctaaaaaatctagaaaaacatgtccaaaaggccgaggcgataatttatggcagataacagctacacagatatcatggaaaaaatcatatggaaatcccctggcatgattatgccagacaggatggaaatatactcatagataaggcgggactgattgaaaaagcctctgtaatcggacgtgtcggactcatcatgctctcctgcggcacaggagcctggcgtgtgagaacctccatgaaccggctctcaaaggtgcttggtgtcacatgtacagtggatgtcggacttatgtcaatcgagtttaactgttttgacggcactgactgtatatcgcagtcactcagcatagcaaacacaggtgtaaacacctcaaagctctatcgcatggagcagtttgtcgacaattttcctaacgaggaagctcatctgaccggcgaagaaatccaccgtcgactcgatgagatagagcagattcatgccatttactcccctgcaaggcttgggcttgcagccgctatagcatgctgtgccttcacatttttgctcggcggaggccctatcgagatgatgctggcatttatagcagccggcatcggaaatctcatacgaaccaagcttataaagcatcattttaccttgttccttaatatagcggtatcaatttctgcctcatgcttcatatatgcggcacttttaaaaatagcagagatggctttcaatgtaccatcaattcatgaagccggatacatctgttccatgctctttatcattccgggatttccgtttattacaagcggaatcgacctggcaaagctggatctgcgctccggtcttgaacgccttgcctatgcaataataatagtcatggtagccacgatgtttgcatggattatggcgctgcttctgcagcttaagcctatggactttgaagatttggatctgggccccgtactacatctaatcctgaggcttataatgagcttcttcggtgtgtttggattctcaatcatgttcaacagccctgcttccatggctgcaacagctgctcttatcggtgccatagcaaattcactgcggcttgagctggtagacctgacaggtatgccggctcctgctgccgcatttgccggagctctcacagcagggcttctcgcatcatttatcaaggaaaacaacggatatccaagaatatcccttactgttccatccatagtcataatggttccgggactttatctgtatcgggctatatacaatttcggcataatggcactttcggatgctgtttcatggtttgcatcagcaatcatgattatcattgcactgccgctcggactcatctttgcaagaatactaactgataagacgtttaggtattgcacgtaacagaatcatacacattataagcagacttgttttataccattccaatttcggacagcacaagctctgcaccaacatccaaatattaaactcaaaaaacaaggaggcattcatcatgcttacagcagttacaggaataaactggggagacgaaggaaagggtcgtgtcatcgaccttctcgcagaacatgcggatatcgtagtccgctatcagggtggtaacaatgccggacacacagtagttaataaacagggaaaatttatcttaaatctgcttccatccggaatacttcacccagatgtagtatgtgtgctcggtgacggaatggttattgacctaaaccatctgtccaatgaaattgcacagatcagaacacaagatgtatctgtttcaccaaaaaacctgaaattatcaacaagagccacaatttcaatgccgtggcataaaatacaggatgagcttgaggaagagcgcctttcaaagtccggagcagccttcggctctaccaaacgcggtattgcctatgcatacagcgataaataccgtaaaaaaacaatccgtctcggtgatttactccacttagacgaagagaatgtacaggccagacttaagaccatgcttgaagctaaaaaccttgagcttgcaggctgctatcatcaggagcctatgtctctgtcagctcttttgtcatggtgcaggcagaaggctgcaaaatatgcaccttatatcacagataccggtgcattccttgaggatgcactatcaaagggaaagcgtgttgtacttgaagcacagcttggtgcaatgagggatatagactatggtattttcccatatacttcaagctcctccaccatctcagcttacggtcctataggtgccggtatccccggtgcctcattagaccatgtggtcggtgtactaaaggcatactctacctgtgttggagccggaccatttgtcgcagaaaaagctatgaacggtgaatggactgaaatggtccgcaagtatgggggcgaatatggtgctgccactggaagaccacgtcgtgtgggtccatttgatgccgttgcaagccgctatggtctaaaatgccagcatgctgacaaaatcgcactgaccaagctagatgtcctaagcattatggatcagattcctgttatcacaggatatcagtataaaaatgctgtaacaaacgtctttgaccccaccgaaaatctcgaaaaatataccccggtagtcaaaatgctgccggggtggaaaaccgatatatcaaattgcaggtcatatgatgagttgcctgtaaatgctaagcgctacataaacttccttgaggacatgctaagacacgaaatacaatttgtctcagttggagctgagagaaatcaatatcttctcaatggtaagtggctgtaattgcctttaaccgacctttgccttgttcttcttagtcgctgcctctgtcatcgcatacggatcaagcaccacatcaagctgcttttccttcataagtccgtgctttaaaagcagcttctggcagcgctcctcatttgcggttattccgatatgcagttgtctgtaagtgtgtctacagcatgtgtgagtgtgcttatcgaatcaaaaagattatagaattgattccgggattctaaaaaaatactatattatttttctgatttactaagatattgtatacacgaatgtgctgccacatttccttctccgacagccttagtatactggtatggcctgcctgtgcagtctcctgccgcaaaacagcctgccacatttgtctgttgggctctatccaccaatatatgtccgttttctatttcaagctgcggcataagctttgatggtgcaatggcatttctcaggcagaaaactccgtctacgctctcagtctttccgcttcgaagcgtaattccttccacaaatgaatctccgattaatgctataggtgcatcctttgatatctttacatttggaagctctatttcactgtcattataggctgggaaatacaatacctctgccgcaagatccgcaagatatttcacctcatgctcatactttttgtcattacatatgacagctatccttttatccttgtaaaacatgccatcacaggtggcacagtaactgagcctctttccaagcagctcatcctccctgtccagctgctttgcagacatcacacccatgcaaagtatgagagtccttgcctcatacatctcattgtctgcaagcaccataaagccgtttcctgcaggcatgatattggtcacagtcttttctgttatatcaattcccgcagctctcctatgagcatcaaagcgttcaaacagctcctgtccgcttatctgtggaaatccgggatagtttgtgattttctctgccttttgcaccttttcgcttaggttcttcgaaccaaaccagataaaatcctttttatatgtttttaaattcagggctgccgacagtccggcaggacctgttcctattattatactatcgtacatgctatgctccttgtaccaaatatttgtatatatttagaccttatatatagtgtggggcactaaggtatacatcgaattgcatgcaagtatgcatcgatgatacgaccctttaatcatattatattattgtaacgtcacatacagtgcgccttcaatgcttcgatatactcccttgcatatcgcgagagtaccacaccctttctgctgataatacctatcctcatatactcctccacatcaagtgactttgatataatattccttccattcagctcagcagaaatcactcctgagcacactgtatagccatttaaaccaattatcagattaaaaagtgtagctctgtctcttaccctgatattctttctgctgtcaagagtgctgacaaactcctccgaaaaatactgtgaattgtactctccctgctcatacgtcaggtacggatagtcctgcagatcatccatcgtgatgctcttttttgaagcaagcgggtgactgtcacatatgaatacatgcggtgtggctgtaaaaagctctgtgaactcgagttcattacgctttagcatctttgaaagcacctccgtattcttggagcttagatatatgactcccagctcactctttaaattcgtgacatcctcaataatttcgtgagtctgctcctccctgatggtaaaatcatactgatatgcatcaaactctctgattacatccacaaatgcattcaccgcaaaggaataatgctgacacgataccgcaaagtgtggcttactcaccacatcatccttgtagatcccctctatgagatctacctgctcgagcacctgtctggcatgaccgagaaatctctcaccatcttctgatagtatcactcccttgttcgtcctgatgaaaataactatctgcatctctttttccaggtcatgtatagcgctggtcacagtgggctgcgagacaaaaagctgctttgcagcctctgttatattgccgcattctgccactgtcaccacgtattttaattgttgcagagtcatgctcattctcctccggttacatatcgaaatattattttacacattaaatgtcttacatcgcttaagtcatctcgaaactattactgtataccgataatctttctcagtatctcacccaacagctttccgagcataagcggaatgacaacaagcaccacataccacagcagcttgtcataccacaccctgccatcatttatcacacagataaagtgcatggcaacaactgccaccgcaaatacagatgcaagaagctgcaaaaagctcgccacatggagcttatttgttaccttgccaagcgtaaataaaagcatcgcaccaaataacatcgctatatctgcctcccacggtatcattttactatacgaaaacagcttaaacatatcacgaaactccatatgcagctcaagaaacaaatccactgatgctatcatgagcaatactgctcctattgtcgaaaataccgctgccagatatacataattgtttccaatcctgtgctgtctgagcttatatttaagcataccctttttctgcacatactgtgtacgcagataagaatctgtcgcagaggcaatagccctgtcgcagtactcggctgctgtcctgtatactttgactccggcatcgttatttttaagggcaaactccacaaggctctctcctgccctgttgttgccacgctccgtcgcagtaaccagataccctgcaccaagcttctgctccttgccatcaaaaaaggtaatgaccagatactgtccgtaatcggcaagtgcatccacatttccaagctccactgctttcttccaccaaaacactgcgcgcccgggatctcggtatgtgccctggcctctttcaaacatatttgctgccatattcatggcatctgcatcttgcgcctctgccaacgacagaaactgacggaatgcaccctccatatcattttgtctgtatgccaccatagccatatcaaacgctgtacttttcatattgttctccttgacagcctttgctgttttattcttaattataatgtatttaaagtgatgatagcaatatgacttctttcccaatttatagtaaatgccgcacccgaaggtgcggcatctaagaggtttataaaatgtttagtttaaaagctgttttatttgcaagctctcttcttgcgatatgtagctgctgtgattgcaaccattgcaagtccgagtatgcatacatatgtagctgcttcattgtcatcgccactctttggagctgcttttttagtgtcattctgctgtttacctgcagttttcttatcaagagtaattaatgttgcagaaaccttttccggtgttggatctgtcttgcccgggtcttttgttttcttcacctcagtaagaatgactgttccaccatcctttgctgccggaattgtaacagcaactgttttatcacttcctacagtatatgtagcaccgctgtataaatcctttacctctgttcctgctgctaagctaaccggaacttttacttcttttgcggtatccttgatattcataccaacatataaggttgttcctccataggatcttgaaactacatcatagccttcctcatcagaacctgccacaactgttctgcttcctcttgcaaatacatctgtgtatgcattacggatgctaagcagattcttataatgctgatatgtgacattgtcctttgttgccttagagaaatccatgtcatatctattagtctgatatggataattatttaatccacttaaaccaacttcttcaccataatagataaccggaataccctttgcagtaagctgtaaggtagctgcaactaacgctgctgatgttgcttcatcctcggtatagccttttccgtttattaatgaagccttaaatccatcttcatcatgactgcttaagaactgacctgtcatgtatgcgttattaagtgctgaatttcttgcagaaaggaatttctctacagaagaaatattgccacttacaaagcttgttgcctggtcattaaaatcgaaatcaaggtctgcatccatctgaccactacctaaggtactaccatttgacgcatatcctgcaccataatattctccaatcatcttgaaagacggatttacttctgttgtagaatttttaagtgctgcccatgttgtactgtcaacatgctttacagtatctacacggaaatagtcaacaccataatccttcatccatgatgtctgccattctactaattttgccctgacatctgccttttctgttgcaaaatccggcaatccagactgccatgatttaatatcgccttcactgacgctcttatccctaagcatatcagcaaatgttgattctgtaccatatcctgcatggtttacaacaatatcaaccataatacgcataccacgtttatgtgcttcgctaatcatagttttaaattcttctgttgtacccattgtaggattcaattttgtaaaatcacttgcccagtatccatggtatgctgcattataaggaacatcttctttaccctcatctgtcacagttacacctgcaatattctttacaattggtgtaagccagattgtatttactcctaaatcctgtaagtaatctaacttagctgttacaccggcaaaatctccaccatgatacagtccagggttgtctccgtatgtatctgtaccacttgctgtattgttagattcattaccatcaaagaatcggtctgtcatcataaagtagacaacagcttcatcccagtcgaaatcattttcatttttcttcacacgatctgtaatttcaacatcaactgtagtactgaatttattaccatactggtctgttacagtaattggtaatgtcttaattcctaatgctgtatctgttgttgcagaaatggtaactgcctgcagttccggctcaatcggcatctcactacttccaccaagtgaagaaacatcgatacttgcacttgcaacttcaagtttctgagtatctgtatcagcctgtttaacattaaacttaactacattattctcattgtagttaaatgacttattcataacttctgctgtaactgttgcatttaatttatagtattcaaaatatgagtaatctgcgtcattatatttttcactatttgaattgaatgcatctacaacataatttccatttgctttgtaacgataatgtgttttgccatttgttaaaccattctttacatactcaaaacgctttgttgtatcattgtatgtcattggatactctgttccgtttacgtcaacagatactttcatatcctttaaggtgccatctacaaatgcatcatcatcacgatagtagtatgatacctgttgattttctgcatctacttcatagccaacattatatggcatagcaatttccggctcactgccggctttcatgctggcatagataaccttctgatcagaagggaatgtaactgaatggtctccaccatctttaatccatgggtcacctgttgaatctaatgcaatacaaaaatcaacctttgtgcaggatggttttgctgggattgttactgtccatttatctccacctacatatgtaaaatcggttaatactgaagcatatcctgatgaccatgtataaaactgtggtgtaatacctttttcttttaatcccggattctcataatccaatacaaggtatctcttttccgttggtacgattaccggtttctcatgaaccggatcggaaccatccacataatataatacctcattctcatcaccgcttattgtaaaagaacgatctgcagtatcagagccgccatcccatccttttgtattatcatagcgtgcctttaatcctaccgtttttcctacattactgccggcaactgtaatggtctgtttaaaccatgtcactttattttcagcatcataatatgttccgtcaaaaacataggaaccgtctaatccggcattccacatccacaaatcaacttttcccatgtctgtgtctgttgataaatcctcattgtaataataaatagtaaatgtgtggtctggaaccggtgcctcccagctgtccggtgctgttttatatacggttgtatcaccttttgttccggtaacccagagctcagtactagttgatgtcacagaaacatcaatattatccgtctgtgttccgttgttattattaaaaatacagctgaaattctgttttacatcctgtgtatatactacatcataccatcccaaatgatcagcatttgccgaaatctgtccgcccggccattcttttccaacacctgctcctgttgcagaggcatctgctccccacatataattgtaaatagtacttcccattcctgaagcaagataatgaatggttgttacatatttccaatcggcaggttttgtctctgacaaagaaccatcgaaccagtactctgcttctgcctttccttttgtagaaagtgttacgtcgcttaactggtttccatgtccatcatcatttaagataagattataatctgtactgttatctaatgtcagatgcattgtataccagccttcatgtcctgctgttgcagtcatggtttttcccggccattcacctgccggcttattagtctccttatatatatatgctgcaacatcatcgcctaatgtgctcttataattaatagtcagatcacattctgttggtacagactccggaatcaaagtttccttctttgaagcatccttataccactgatattttccattgtcatccaataaacaataaatgcttgtatcagaagtaaaagtcttaatctgctcaattgcagctccttctgtctttatctccggtgcagactcatctttagaacctgcatcaacaaactgaaaacctgtccactcactgctctgtacatctacataatagagtccagaactttcctcatatgcaagctttggtttttcctgattcccccattgtgaaatggtggcatttcctgcgccatggttatctaccgcagcaccggcagcccagacatggacaaccggtgtattccatgtacttggtttgtccaaatacaaccggattgtcgggctcgcagcatatgcagtggttgcaccaccgattgctggaaccatggtcataatcatagcaagcgcaagtaccatactaaatatacggcttacaatgccatttttcctgtgaaaacgttcttttaactttcccatatttcctctccttttcttattatgtttgtacgaaaatcccctttcgcacgttttcgtatttatattatagtcttttcgttggttttcgactattgggataaacagagattttattcacgtaattttgttaaaatttactatttattcatttttatgtaatatatgcgaaatctttttagtactaaaagtcctagatatagtagataatttttcatttgaaattttgtgaattattttttaagctatttccggttttattcgaaatcccggagctgcactgatctttgaaaggaaagttctcacattgtttttattgaaggaagctcttacttttcctgtgttttttcaaataaaaaggcacggacaagaagctgatattcacttacatcatcataaccaccgttgcatttttgaagcaaacagtctgcgtccaacagaattgtcttgagacgttggttataatattccttcctctgccggtaaatcactttattgtaatcagccgaatcatagtaatactccaaccggtgtatttggacgtgattttctccattttctctacatctattgtaccacttataaagaacgaatttatggttatgtgaagttttcaaggtaccaatttatggtttacaagagattgatagcatagtaggcagaccttggggagctgtaatccttaaatcttttaaaacagcacccaaaattcagcccaaaagccggaaaaattgcgagaaaagtagctgaaactgcaaaaatcaccaaaacagcttccaaaaaccagcccaaaagctggaaaaattgcgagaaaaagtagctgaaatcactataaatcccaaaacagcacaaaaatatgaggattatggcataatggtgggctttaattatttcacaaaaaagagccctcacatttctgtgcaagctccttttgaaatctaaaaaaatataaaactataaaaaagtatattgttttttaattatatatttaatctctaaatcaactatccccagatgatttcttccttggcggcctccacattttcctcagaatgctccacttcctttgagaagatccttgccacttccatctggtcctctatggtgaagctgccaccgtttttgtagaaacgagtagcattcatatccctgactatcatggtaaacatgacgcttaaatatgcataaaccatgatatttgagtcatagatggcattcatgatatatctgaaggtaaagtatacaagaagctgctcaatatcgttttcacggtaatcgccgctagtcatgtactccttcatgcgtttttcataatcagcctctgtgaggactgtctgcatatcatccttgaaatcctgccacacctggcgcaatagttccatctcattgataataccgaagcggatatcaaaatgctcaaatgaaaaatcattaaacgaaagccagtctatatgcttttcaacatcgttttggctcagcttcttctggtactcgtttgccctgtcaagatactcatccacgcgtactccgattggctttgtcctgtcttggagtatggcgatcagctcgcgctgcacctcctcaaaaaatgctgcctcttcctctgtgactccctggtcatcatcgctatcgccaaaaagctcctgttctacaaacttaacaggctttgttttgctgaaaaatatacggcagacctcctcgcacgcaaggctcaggcacttctgctccacgtttctgtactctatgccaaaccttggaaaatcggtgcacacctcactaagcgatgcctcgccagctgctatgtacaaatcacacagattcttgtcatttagcatgatgcagcgaccgcaattatttgtacggatgccgtgcccgccatcctccgtctcatacatgccctttctcagacgctctccgacctctccgggcagtgtctgataatactcatatgaatcctcatcaatatcaatttcccagcccagacagcagctatccttgcagtctccggctatgcagctaaactctgaaaaataatcaggtacacggactatcatacttctctctccttcagtaaatcttcgtttgttgtatcactgtgcttatttctgaagcgcgcttctatagccgcccagtcagggtcctcatttcccttaaaaaagttgtagcctatgtatccgatgcaccacacaagccctgcaaatgtcgtagaaaatgctatctttatgatactcttaagcaagagtggaagtgtcagcatatcattgccaaatgctatgataatcacatgaataggcttaatcagcataagataacctcccacataaagcgccgctaaaattccaagcgcatagcacagtattcctaataatttgtcgcattttttcttcatttcaaatcctcttcttaaaatacgcttatcaaagcttcttcttaaatcttcttaaatcttcttctcaaattttcttttctaattacaatacagcaatttagtcacacataacgatttatattttcgtaaattccagtatagacacttctcctgttgctcttgtcttctccatgtctatcacacgctggtttgcagagcccttgaatttgagcatgatatccttctgttcctctataaacggaccatctaccaggacatctatcatagataaaagctcatccgtatactctgtgtgcttgcgtccgttttctaacagttcttcgtacagatagcctgtgtaagcccacacatccttattgggatagcgctccttaactcttctcataaacggcacaagtgcctcctgattctcctcctcaaaaggatcaccgcctaaaagggtaattccctgcacataggcaggcttaagcgagtcgagtatctcgttttgtatctgttcatcaaacggctctccatagtcaaattcccatgtctgcggctgaaaacagcccttacagtgatttctgcagcctgatacaaaaagcacagtgcggcagcccagtccgttcgctatgtcacaatattttattcctgcgtagttcatactttttcctcgtatctaagattatagttccatttaaaaattgcactgcctattattataacatatcctatcacacttagatagtccggtatctgttgcaaaaagacaaagcccaacagagctgcaaagataacctgcgaatagtcgaacaccgatatctcctttgcaggtgccttggtgtatgcctttgtgattgaaagctgtccgcctgtagcggcagctcctgcaaaaagcagcatgacaatctgatatacactcataggctttgctccgacaaacagaaacggagccgtcactatacatgaaaataccgaaaagcacatgactatcacaggccctctctctccctgcttaccgagctttcgcacaaatgtatacgctacacctgcgccaaaacctcctattacaccaatcatggcattaaaaaactgcacattcatagatggcttcaccacaaaaacagcacctataaacgccgtcaccacgcacaaccactctgtcttgtttgctttctccttaagcacaaaatatgacatgattatggcaaaaaacggtgacaatttgtttagaatattggcatctgcgatggccagatggtcaactgcatagaaattgcatataagccctgttgttccaaagaagcttcgcagaaaaagtcccttccagctatccttttttattttgaagccttcatcactttttgcaagtaagataacagccgccactgctgctaccgcattcctgaaaaaggccttctgcatggtcggcaaatctcccgacatcctcacaaaaaatgtcatcagggcaaaaaagaatcctgccattatgatatatattattccttgtttcttatcgttcatacttatagtataacgtattctgtcaagaggggataaacaaaacgtctgccattttgctcgcaaaaaagaccgcccggatgagcggtccttttaagatgaatggaaaaatatattaaattctgcctacggattccccctccagcaaaattccttcaacaacagctctctccacaagtgctgttttaggctttttaatgatgcttatcaacctgtctgctgcctccctgcctatcttgtcagtgtcctgtctgatagtggtgagcttcgggcttagcatctgtgaaactcttgtaccatcgtatcctgctattgatatatcctccggaatcctaagccctctgcttcttataacattgatgcctccgattgccgccgtgtcatccggatagatgatacatgtaggtttgtcaggtaaatcgagtaaatattctgtctgatttgcaacatcctctgtttccagataccttgcttccctgacatactcctcaggaatatctattccatgcttctcaagtgccctgtaatatgctgccagcctgtcacgtgtaacactcgaaaaatcctgtccatgtatgtaagcgattttcttatgtcccatgcttattatgtaatcaagcagctcgcccatacactttacattgttggaacttactgccgaacagctatagtgtacgtagtcaattgtgaccaccggtatgtcgctgctcatcagttcctgcacctcattgtcctgaaaccttgcacatacgattacgactccatcgaaatttctgtacttacagtgctccaggtatgataatttttttccgaccggacttgtattgataaatgtaatatcatatccaagcatctcagcctgtgccttgattccgtttagcactccggcaaaatactcatgcgtaagtcccatcgccgcctcatcgaaatacagtactccgatgttgttcgactcttttgtcttaagaactctggccgcagcattaggaagatatcccatttccttagctatcttctttattctgtttttggtctcagcgccaatatccttctggtcatgtaatgccttgctgaccgtcgctgtcgaaacaccacatctttgtgctatgtcttttagtgataccatatcgtttcctcatttcgaattgatttcttaatcgttttcgtatctttactataccacaatttgttattattgcaatccctaatttacattttcaacatttttcacactttttattatcttttattgtacattttgtatagtgtcatgttatgtatttaaaacgattactcttttggtcttaattattatacaattataattccttaagtgatattatctcatcagcatttttaactataatatgcagttttctttgtatatatgtcataaaagcattattttttattgttttatgcttgatttttagatattcgcattatacacttctatgtataagtaacttaaacgtttgcgtacatttaataaaaaaggagattttatatatgaaatttggacacttcgatgatcaaaacaaagagtacgtcatcacctctccaaggactccgttaccatggatcaactacctcggatgtgagaatttcttttctctggtatcaaatacctgcggtggctacagcttctataaggatgcaaagcttctgcgtctcaccagataccgctacaacaacgtgccatacgacagcaacggacactactactatataaaagatggcgacacaatctggaatcctggctggatgccttctaagaccgagcttgactcatacgaatgccgtcatggcatgggctattctgttttcacaggaataaaaaacggcttaatggctcagcttaccgacttcgttcctatgggctctacctgcgagatcaataagctcacattgaaaaacacatctgataagaaaaaagacttttcggttttctcatatgtagagttttgtctgtggaatgccatggatgacatgaccaacttccagcgtaacttctctaccggagaggttgagattcatgccggtggctcccagctcttccacaagacagaatacagagaacgccgcaatcactatgctgtatatgctgtaaatgcctctgttgacggatttgacacagacagagattcattcttaggtgcctacggcgaaaacagcgcgccttccgttgtagtaaatgatcagtctaagaactctgttgcaagcggctgggctcctgtcggctcacatcacctgaaggtagctcttgagccgggcgaagaaaaaacatatatatttgtacttggatatgtagaaaaccctgtgaacgaaaaatgggttggacgcgctaaagacggaatcataaaccgagctcctgccgatgcactccttgcacgatttgacaccaccgaaaaagccgacgctgctttagcagagcttaaggcttactgggataagctgcttggtcactttagtatctcttcatcggaggaaaagcttgaccgcatggtaaatgtatggcatcagtatcagtgcatggttacctttaacataagccgctctgcttcttattttgaatcaggcattggacgaggcatgggctttatggattcctgtcaggatctgcttggcttcgtgcatctgattcctgacagagccagggagagaatactcgacattgcagccacacagtttgaggatggctctgcttatcatcagtaccagcctctcaccaaaaagggcaatgccgacataggctcaggctttaacgacgaccctctgtggcttatcgctgctgccgctgcttacatcaaggagacaggcgactactctattcttgacgagtcaacaccatatgacagcgatccttcaaagacaactgactttatggagcatctgcgccgctccttcaactatacaatcaatcatctcggacctcatggtctgccacagattggacgtgctgactggaacgattgtctgaacttaaactgcttctccgaggagcctggcgagtccttccagacctttggaccatctgaagggcctaatgccgaatctgtttttatcgcaggcatgtttgtaaaatatggaaaagactatgtaaaaatctgcagacacaagggactttgcgacgaggctgatacagcccaaaaggctatcaaacagatggaaaaaaccgtcatggatgccggctgggatggcgagtggtatcttcgtgcttacgaccactacaagcacaagattggttccaaggaatgtgaggatggaaaaatctttattgagccacagggcttttgtgttatcgctgaaatcggaaaggatgaaggactctgccttaaggcaatgcagtctgttgaaaaatatcttgatactaaatatggcatcgtgcttttacatccgccttatcacagatatcatgtggagcttggtgaaatctcttcttatccaccgggatacaaggagaatgccggcatcttctgccacaacaatccttggatttctatagctgagactgttatcggccgtggaaacagagcatggcaggtatacacccgaacctgtcctgcatacatcgaggatatcagcgagattcaccgcaccgagccttatgtatacagccagatgattgccggaaaagacgctcctaactttggtgaagcaaagaacagctggctgacaggtactgctgcatggaccttcctcgatgtctcacagtacatcctcggtatacgtcctgactacgatggtctcatcatagatccttgtattcctgacactatggacggctttacagctaagcgcaagttccgtggcaatacttaccacattacggtcagaaatcctgctcacgtacaaaagggtgtgacaaagctcatcgtggatggtgctgctattgatggcaatatgattccggctattaacggaaccggacacgatgttacagtcgaggttacaatgggttagagataccagacaggcctctgtactgcttcaatatgacctgaaatacgaaaatgccgccgcagagcttgctctacggcggcatttagactgatggtgattctcttcccatgtctttatttcttctctaaaggatgctgttatgtaattgagacctgccacatatgctcctcggtctctcccatgtgaaacagctctttggtctgctcatcatgagtatcatcaggctcatagttgccaagaagatgtatgagatacttctcctgctcatctgccggcgagaccttatcaatgtgtttttgcaattcctcaagaagctgttttggctccatgtcggcatcgactgcgattccaaagcacttcttcgcaagacctgctgtataatacagctcgtagttacttacaagcactgatttctggcgtaagcatttgagtatgatgctttgtctggctattgatgtaatcatattattcctttccgagttagctggaatacctctaagtccaagttatttccattataccctatttgctttttgtttcaagagtatagcatgatatagctaaagataacttaagagagtcctatgaagtagcaacaaatcccgtcaggaaataataaagtgctcccattgcctttccaatagccatagaaatcactataatcccaagaccggcgcgaagcttcatgcgcttatatataatagggaatgtgtgcagtatttctgcgagtgcaactgcaatacagccgacaaatattccgacacacaatccatatattgcaataattatattcccacagatattgcttacagatactttgggcatatttgcaaagcccagattatatgccgtatcaagcactgacgatatattacctgccaccacaccacatatcatgacattttctataagtattatattttctatcctgctgcaccgaagtatacgaggcaccactcctatcacgagcacgaatgcaaatacaccggctgacactcctgcccctgctaaaaacgctatcactgacaaaattatttcacgcaatatatattcaaacatcctgcttttcctttaccttgtctattattgtgttccacgtatccttattatgcttatccatctccacctgaatcggtgtgacatcgtcggatagcttacgctttccgatatgattaaaaaacagtatgattccaaccgccagaccaatgcagtaaaacacctcaagcaccgacacctgtggcttgtccacacccattatctgcttataaaaatgctcaaacacacctgatatcgaaatatcattattgaaagccatgattgtaaaagctgaaccaaaaaatataagtatacacaccgctgcaacctttagtgcttcaagaatcttatttttgctgttgtcgtcatactctacaagtatctccggctcaccaatgcttataacctgtgcatcatcatagatttccgtgatctgctctattattttcattacagatatcacactctttttaccgcgtatcttatccacgatcattccctttatctgcccctcatagcgtgaatatttacaatacacacttgctatgtcattgatgcagacctgcctgcgatgaagtgttttctgctgttctgcgcgtatatacacgaggattttttcttttgaggtatcagtatgctccggcattttcatgctcccttcgattaatattcatatgtatataatttccatttattttgattttatacactaaaagatacacatgtattaaatcaatatttttcgtgcgatatattgtttttttcgtgcaaacatcataaaataaatataattaatctaaagagtgaggtaacaaatggcatacactaaggaaatactgactctcgccgtggaaattggcgattgtatgctcagaaacggtgcagaaatctacagagtggaagacactgtggttcatatactaagttcatatgaggtggaggaatttgacgtatatgtgctgtcaaacggaatatttgcaagtgcaaatgagaacagggaggatgcctgcagcatcgtgcgccacgtaccgcttggtgctgtcaatctggcaaagatcagcgcgttaaaccagctcgcaagggacatatgtgaccagaaaatctccctgattgactcatgggacaggcttgagcagtgcaaaaatattcctaattacaaaaaaagcgcacagattttcttctgtgggctcggaagtgcctgcttttgctatctttttggtggaaactggcttgactttgtttttgcatttgttataggctcactggagcaggtgcttttgtttggtcttaaaaaatataagttcacaaggattataaccaatatccttgccagtctttttgtgacactgcttgccaccgcaagtacacttacagggctttctcttttacctgataaaatcattataggagctatcatgccgcttgttccgggaatagcatttacaacatctatcagggatatctataacggggattatctttccggtacgatacatctgctcgatgcactgattacagccgtgtgtgttgctgtgggagcatgtctgccatttgttgtaatgaaatatattggagggctttaagctatggagtttataatacaatttattgtggctctctttgccacattatcgtttgcagttattttttccgctccaaaaaaggagctgttttactgtggttttacaggagcgcttggctggatcatctactatataatggttcagtttgatatgggtgttgtgtttccatcgcttatcgcgacactgtgccttacgataatggcgcgcatttttgctgcggcacgctctatgcctgtgacagtttatctgctttccggtatctttcctcttgtgccgggagcaggaattttttacacggcatattatctttttactaacgacagggcactttcctcctcaaagggcattgaaacctttgaggtggcgggtgccatcgtgcttggtatcatattcgggtttggcataccgcagagtttgtttaatctgttgaagcctaagaaaaaatgaattacttgaactatgtcaaatttacaattttctgcgccagatcctcgagatactcccaacgctccattttctccatcagctgcccctcgaggttttctttttcctttgtgagttcgtttaacttaccaaagttagtggcattctttaccatctcatcatctatctcagaaagcctgttttccagcttttctatgtcagcctctatcgtctcgtactctttttgctctttgtaggtaaatttgagctttttctcatgcccccaggtttccatggatttcttcttccgggcttcttttgagtctgtaccatttgatgcagtatttccctgtgctcctgaagcggatgctcctgtggatgatgcattttctgatacagtttttcctgatgcaggctgtgggcgtttattcatatagtcggtgtatccgccctcatactgtacgatttttccggctccctcaaatgcaaaaatacgctttgcgatcctgtcaaggaaatacctgtcatgggataccgtgatgactattccgtcatagccatccagataatcctctaaaatagccagtgtctcgacatccaggtcattggtcggctcgtcaagtatcagtacattcggtgcgctcatcagtacacgaagcagatagagtcttctcttttctccacccgagagcttacctaccgggctgtactgctgctccggcgggaataaaaaccgctcgagcatggcagatgctgacacaaatccgtctgccgtgcgcacaaactcggcagcttctttcacataatctatcacacgaagctcaggatctatatccacttcctgaccgaaatatcctatctttatcgtctgtcctatctctacctcacctgaatcaggctcgataaaaccggcgattatcttcatgagtgtggactttccacagccgtttttgcctacaaaaccgatacggtcatttttcaggaaaatatacgtaaaatcctttacacagacgatatctccgtatgcctttgaaatatcatgaagctctatggtcgtccttcccatacgtgatgaaaccgatgaaagctcaacttttccgtctgtctgcggtcctttctgatcgcgtaaagcctcatatctttggatgtgtgccttctgctttgtggaacgagctcttgcgccgcgttgcatccactctatttcttttctaaggatggactgacgcttgcgctcacttgccctctcgctctcctccctggctgccttaagctcaagaaagcccgagtagtttgtatcatagctgtaggtctgtcccttgtccacctcaacgattctgttgcagacactgtctagaaaatagcggtcatgtgtgatcatgatgattgcacccctgaaacggcgcagataatcctcaagccactccaccatctcatagtctaagtggttggtcggctcgtcaagtatgagcacatcacacggcttaagtacgactgttgcaagcgcaagcctctttctctgtcctcctgagagctcaccggtcttttgcgccatatctgtaatatcaagcttcataagaagtgactttgcatcactttctatactccagcgcatatcctcatccagctgcgaggtaaccacacggctcatcacatgttcaagtgctgtctcgtcagggtcaaactccggattctgcggcagatagtttatcactatatgatttgctgtggtgacagttccctcatccggctcttcatcaccagccacaatctttaaaagtgtagactttcctgtaccatttatacctatgataccaattttttcgttttcctgcacataaaaggaagctttagaaaaaagcttccttccagtatatgactttgttatattttcgacattaatgatgttcatcttctcgtattttctcctccctctcatgctcctgcttctccttggcctcaaggattgcctcattgagcgaaagcatctttgcatcaagctgtcctacgatacctgcacactcgcgcagatcgcggctgatatactcaggtgcattgccctcgaacttgtaatatatcttgtgctcaaggcttgcccaaaaatccatagctattgtacgaatctgtatctcaacctttgtgtcaaccaccttgtttgaaagaaaaataggcaccgaaacaatcatgtggtagctcttgtagccgctcgccttcggatgcttcatatagtcctttaccgatatgacggtcaaatcattctgcctgccaatcatctcagcaagcctgtatatatcagatgtgaacgagcacacgattctgatacctgctatatcctttacatatgtgaccatattctctatggtgctctcgtagccaccctttttgagcttctttactatgctttcaggagtcttgatacgcgactttatgtactctatcggattgtaattatgtatgtgaacaaactcgtcatttagtatctcgagcttagtattgacctctttcagtgcagaattgtataaaaacatcatagtctcccagctatcgatgccctccgcaaactcttgttccattaaaaacctccctgtgatctattcgcctgtatgtttatcagactctcttaatcaattatagcatatttattcgcataattggcaaattatacctattatttatatattttttattcttgttattttgtatgtgcacaggtccgcacactgcaggcacggcggcacacacgtactctctcgtaagcgcatagcgaagctatttagaatctgttgaattatgcttcacaaccagaaatgcaccggcatggacgccggggcaaggcgttatgcgccatggacggcgcataaaagccgttttcgtcaagcatcgaaaaccaaaaggcatcaatcctcctcgatgacgtgcatctcgagaaaatcaaagtcgatatcctccacaaaattatccttcgtaaagcgtgtctttccatgcctcttgaaatcacttacgttgctgtcaagccagatgggctttcccaggtcaaaagcaaggcaggcatcctcaagtgccttaaaaatcttgtgtgtacgtgtgtcgtcactgtcattttctattgtaatatcacgcatcaggtgcgtgtcagtataaatcttaaaccaaatacgcatattattctcccaaaagtcttctctgacgattgcattcatacatgagcaaagtggctgatattgcggcattaagcgactccacagctccctccatagggatgcggatatatgtgtccgccatgtcagctatctcatctgataatccattaccctcatttcctatcataaagccacaggctccggtgtagtccggtctgtcataagagcacttaccctttaaatgagctgcgtagagagaaactccctttgactttgcatactctatagtctccggaaggtcatctgtaatgtaaaacggcacacggtagagtgagcccatggttgagcgcacagtctttggattaaaaatgtccactgttgtgcgattcattataataccgcttacacctgcgccctcaccggtacggatcatagtgcctaagtttcccggatcctgtatactctcaagcacaagaagctctgtcttgtcgcccttaaaaagttcatctatctcatagtgcggcatctttactatagcaagcacaccctgcggagtctgcgtgtcagacatgctcttaaacaccgagtcactcactatttctgttttgtcaaggaaacgcttcttctcttccttaaacctgtcatcattaaaaaatgtctcagacatatatacggcacttacccagtcatatggcgcctcaaagctcatctttggaccctcaaccacgaatacgccctgctttttccgctcctttgccttgcttaaaagagcctgcacattttttatgcttttgtttgatgcacttgtaatcattttcttctctttctatattgatgatatgagggtcaaaaagtattttgcccctcatttatgattaatcagattactacatgctacgcattcccgtaatctgactacacctcgaaatccgctaatttcctgcgtctccgcagcaaattgctactgacagccaaaatgcccctgcaccggcacatgcacgcaattacctgcatttgatgtgccggatacaagggcattcataattatcgtaactatacttagatactaaaccagagatttagagatatcgtacatgtactcgtctacactcttcttcatagcaagtgcctcgtcgatatcgaaatctacgaaattgccatccttgtgggcaataactctgtttgacttgccctcgcagagtaaatcaactgccatagcgcccatgattgtagcgtatacacggtccttacatgaagggcttccacctctttgcatatgtccaaggatagttgctcgagtctcgatgcctgtagcagcctcgatttccttagccatctcctgtgaatgtcctacgccctcagcattgatgatgatgtaatgctgcttgccgagctctcttgcgtgagctactctctcgatgagtgcctcaaggttgttgtcatacttctcaggaagtaatacttcctcagcgccgtttgcaagaccacaccataatgcaatgtatcctgctccacgtcccataacctcaattattgagcatctctcgtgtgacgtagatgtatcacgtaccttgtcaatagcctccatagctgtgttgcaggctgtatcaaaaccgattgtgtaatctgtacatgcgatatcaaggtcgattgttcccggaagaccgattgtattgatgccaagtgctgcaagtttctgcgcaccctggaaagatccgtcaccaccgataactacgatagcatcgataccatgcttcttacagatttcagcacccttctgctgtccctctgctgtaacgaactccttacatctggctgtctgtaagattgtaccaccgcgtgagattgtgtctgaaacgctctttgaatccatatccacgatttcttcatttaacagacctgcgtatcctctcttgattcctttaaccttcttgccctttgagagagcctgacgaacaacggcacgaattgctgcgttcattcccggtgcgtcaccaccacttgtaagtacacctattgtgttaatctcttttgccattggtataacctccatatgttaaaaaattatcatttattctaatcccaatctattgtacttgttttagcacattttttcaatattcttttcaacaattttcgcattttctttgtctaaaaatttcaaaagctgctccatgagctcattatttgcatttacggaataatttctgccaagttttttcatctgctttgtatctgcgatgtaaattatgacttcatctcctccgtcagattcacggattgtctcaagaagcctgctctcatttttcttatagtcctccattgtatcaaacctgagccatagctgcttcggaagctcatcaaacggtatgattttctcgcagattatcttgccgttctgctcatcctcgactgtcgcatgtccgataacaaatattttagcatcgtcctgtaaatatctctggtagcgctcgtaatctctcggaaaaataattacctcaacagttcctgtcaggtcctctatcgtgataaaagccatggcctgattatacttggtaaacttaatcgtctttgtagctatcatgcctccgattaccacgtgcgcattgtcctttatctttacggcaccgctctcctcttcaagcacaaaatctatcgcatttgctgtgatgtttttctttagggcagctgcatatttttccagagggtgtccgcttaaatagatgccaagcacctctttttcataggccagagcttcctcagcgtcatattcaccaacatttggatacttaagctcaaatgactgcctatcctcatctgagaccaggtcaaacaaactcatctgccctgccattgttgactttttgtcatgctgcaccctgtccacaatcgatgcatacaccattgccatctgctttctcgtgccgtcgagtgaatcgcacgctcccgcctttatcagattctcaatcgcacgcttgttgataagctccttctggcaggttctctcaataaaatctgagagtgtgcggtatctgccaccactttcccgctcctcgattatctggtctattaccggcctgcccagagatttgatggcgtacatgccgtatctgacatggtcaccctctgcggtaaactcgccctgtccacagttgatatcaggcggaagcaccttaatacccatatcacgacagctgtaaagatactgcgccgccttggctgaattgtctataacggaagtcatgagcgctgccataaattcgaccggatagtaatttttgagccatgcagtctgaacactgatttttgcatacgcggctgcatgtgatttgttgaacgcatacttagcaaaatcaaccatcgaatcgtatatgctgttggcagccttttcatctatgccgtttgccacacagccctttataccgcgctcctcgtctccgtacacaaagctctggcgctctgcgtcaatgacatactgcttcttcttactcatggcacggcggatgttgtccgcctgacccattgtatagcctgcgagcttctgcactatctgcataacctgttcctggtatactatacagccgtaggtcggctctaaaatactctcaagctcaggtgtcacatagcttatctcctttggattgttcttgccctttatatagttgggaatgaaatccataggacccggacggtagagcgaaataccggctacgatgtcctcaaagctctgtggactgagttccttcatgaagctttgcataccggcagactctagctggaataccccttccgtctttcctgttccgataaagtcaagtgtgcccttatcgttgaaatcaatatggtcgatatccacatcaatgccccttgatgccttgatattcttcacagaatcctttagcaccgtgagtgtacgaagccccagaaaatccatctttaaaaggccaagctcctcgagctgtaccatgttgtactctgcggtagggcttccgtcgtttgcccttccaagaggcacataatcgctcgccacacccggatagattaccacacctgctgcatgcacggacgtgtggtttggcagtccctcaagcctttttgccatatctatcatttcatgcactctcgcatcactgtcgtaaatgcccttaaactccgggttcatctgaagagccttgtcaatcgtgatattaagctcctgaggcaccatctttgcaagcctgtcagtctctgcatatgggaaatccagcgcctttccgactgattttatgactcctcttgctgccatcgtaccaaaggtgactatctgtgttacagaatcgtgtccgtatttttgctgaacatactctatggcgcgatatctctccgcatactcgaaatccacatcgatatcaggcatggaaactcgctcagggttaagaaatctttcaaaaagcagattgtatttaaccggatcaatatccgtgattccggtacaatagcacaccctgcttcccgccgctgagcctcgtccagggcctacccagcagtcgtgcgtgcggcaccagttgatataatcccacacgataaggatatactctataaagcccatggtctttatgataccaagctcatagttcatatctgcatgtatctttttaagctcatcagcactgtactcgccacagcctatgtatttctccctaaagcccttctcgcagagctctgtaaggaaggcttcggcactatcatagccctctggcacctcatactttggaatcttgtaattgccaaactcaagtgtcacattgcatctgtcggcaattttctgcgtattctcaatagcctctatggcatatgggaaaagcgctctcatctgctcttcgctctttacgaaaaactgtccgccatcatagcgcatcctgtcctcgtcagacacctttttcccggtctgaatacacaaaagcacatcatgtgcctccgcatcggactcgtaggtgtagtgcacatcattagtacacaccaaccctatttcaagctccttgctcatcctaagaagctgctgattcacaagcttctggtcatcaatgccatggtcctgcagctcaaggaagaagttgtcttttccaaagcagtcctgatacttccttgcaatctccttcgcctcgtcataaaagcctctgacgatgtatctgggaatttctcctgccagacaggcagacaggcatataagcccctcgtgatatctctcaagcgtctcaaaatccactctcggcctgtaataatagccctctgtgaaccctattgacactatcttcatgagattggcatagcctgtattattttcagcaagcagaatcagatgataatacctgtcatcaccgtggcttgtctccctgtcaaagcgcgaatttggtgccacatatacctcgcagcctatgaccggattgatatcatttgcctttgccgtcttgtaaaactccaccacaccgtacatattgccatggtctgtgattgcggcagagttcatgccaagctccttgacgcgctttacatattcttttatcttgtttgacccatcgagcaggctgtactcggtatgggtgtgaagatgacaaaatgacatttggattcctctttctttatttttgtatcagcgcccgccctttatggggtgtgcggctatctccttaaaataaaaggagataaatttatcagcttcccagctctatgtgtataaacaccgcaagcgaattgggctcctgcatatatgtgatagtgccgcctcttgccgtcggtatgagatatttgtagtcacccttctcaaaaagactgtgacatgcagtatcataggtttctctgtccgaaaacttgaacgtgatatagttagatgacgttgtcatgccctgtaagactttaaggtcgtaggatgtaaaatacagcccattcctgtaataatagtcatcctccactgacgcttcctgcggcagcatatcctcattgtccaatgtacgtgtaagctttaccacatcaagcggcactccgaaccagctgtatgatatgccctttcccagataatcaccatcaccgtaggtacagtccactgcacaccacgcaccgtccagatataccatattccaggcgtggtttgcatcagatgtggtgcctgtcacaataagtgagctgataccggcccggtcacacagatacttaaacatcatcgcatagccctgacagaccgtccttccaagcactgctgagtacatatcctggttgtgaggagaattttcctcatactcggcatgctctatcacatattcatagaaatgcacagccttgtcataatccgatgcaccttcatcgatacctgccatacaggctgacacatagcctgaaatcgtacttattgcgttgtcgatatcagactcagacatattgtatacaggtgaaaaaatgatgctgtttctcacagtatactgactcttttctatgtagaaaaactgtggattgtccagcagcacaaactgctgtatacggctaacgttttcagtgtctgtagtatttaacgaaattccatccatgcacttttgcatcatcgcataaatctgcctgtaaataagcttgtcatcatctgacagcttctcgtagtagtagtgatattcccctgtaaatactgactcatcgtactctgtctgttcgccgtttaaatagtctgttgtggtctgcatctgcccctttactgccctgtgtatagctgtaggaaaatcagctatagcacctataaaccctcctgcctttaagcattttgcagcgaacataaagcaacaggcagcaaacacaagtgccggtatgatttttaaaagctttttcatctattcccccattttaatcgttgtctgtcactctgttaggtgtgaacagcagccatagcaagcctgcatatcagatacagtacaaaaagatgcaccgggtaaaaggcgtaaaagacatattttagtgaaatgcctctttttccattgtaatagcgaagcggtataagcataaacagtgcaaaaaactctatggtacctgagaaaagtccaagcagtatgactgccacggcaaatgcaacatcccggtttgaagaaagcaggtacatcatgacaatgcaccctacacccgccgcaccataatcacagcaaagcacaaactctgcaataatcatcataacaagcactactgataccattactatacacctgatcagtgtgacaaaaaaccacttgactgcagaggatgccttttctattttatcgaccgacttaagccaatcaagcactgtgatggcaagcaagcctaaaagcagtgtaaaaaacacattgttgctcttaaattcgagcactgtattgtttattgcaaggtcaaacggtatctcagagataagcgcgaatataaacatcctcgcagcatatttttccctgctgtgtgtatatttgaagccctccacaagcaggaagcagaaaacaggaaaggccatgcgccctatagaacgcatgacccagtagatatcaataagcgtttgtccacctatcccgttatttatcatctgaagaataaccgttgccgcaatatggtctataagcatggtaaaaatggctataagcttaagcgtgcttccactgataccagactttgcgataactttttccaaaatcctatactcctgccatatttacggtaattctgtcaagatgccagatatcgtccacatattcctggattgttctgtctgaagagaactttcctacatgtgcgatattgagcagtgcactctttctccatgcgctcttgttcttgtaataatcattaatcttctgctgtgcatttgcatatgagcggaagtctgcgaggataaagtagcggtcagccacctgtccctgctgtggattgagcagtgagttgtaaagctccctaaaaagctcatggtcatttggtgaatatgtgccgtctacaagctggtttactacctttcttagctcggcatcgttattatatacatcaacagaattgtagtcatgtctgttctcgtgtgagatgacctcatcagagctcattccaaagataaacatgttgtcagcccctacctcatcgaacatctcgacattggcaccatccatagttccgatagtgagcgctccattgagcataaacttcatgtttcctgttccggatgcctccttgcttgctgtggaaatctgctcgctgacatctgctgccgcaaaaataatctcggcattggataccttgtaatcctcgataaatactaccttgagcttgccgccaatagaagcatcgttatttatcacatcagccacactgttgatgagctttattgttttctttgcatttctgtagcctgctgctgcctttgctccaaaaatgaatgttctaggatagaaatccatagacggattttccttaatcttgttgtacagatacatcacatgaaggatgttcatgagctgtctcttgtactcgtgaagtctcttaacctgcacatcaaagatagaatccggatttacatcaataccattgtgctccttgatatactttgctaaacgcaccttgtttgctctcttaatctcagcaaactcctgctgtgcaacagggctgtccgcataagccttgagctttgaaagcattgtaagatctgtaatccagccggctcctaccttttttgttgcccagtctgcaaggagtggatttgcatgtgctaagaatctacgctgtgtgattccgtttgtcttgttattgaacttctcagggaacatctcatagaaatcatgaagctcctgattcttaagtatctctgtgtgaagctttgcaacaccgtttacagaatagcctgcaacgatagccatatttgccatcttgacctgtccgtcatagaggatagccatctttcttaccttgtcctcattgccaggatatctctcattaatctgcatcacaaatcttctgtttatctcgtcaacaatctggtatacacgaggaagcagtctctggaatatctcaattggccacttctcaagcgcctcagccatgattgtatggttagtgtaggctacacatcttgtagtgatatcccatgcatcatcccatgacagatgttcctcgtccacaaggattctcataagctctgcgactgcaactgtagggtgagtatcgttcatctggaaaacgaccttattcggaagatcttttaaatcgctgtgatgctttttaaaccttgcaagtgcacgctggatgcttgctgatacaaagaaatactgctgctttaagcgaagctccttgccctttacatggttatcgtttggatagagcacctcaacaaggtttcttgcaagattttcctgctccactgccttgtcgtagtcaccctggtcaaaggactcgagcgagaagccgttttttggctctgcatcccatatcatgagagaattgaccacattgttgtcataaccgactataggcatatcataaggcactgcaagcaccgactgatagtccttctgctcgaaatgaagctctccgttttcatctgtgctctcctgcacatatcctccaaacttgacctcatagcagtactccggacgacgaagctcgaatggatatccgtccttgagccagttgtcaggcacctcaatctggaagccgtctgaaatctgctgcttgaacataccatatctgtatctgattccacagccgtatgcaggatatccaagtgtggcaagtgaatccatgaaacacgctgccagtcttccgagtccaccgtttccaagtgccggatcaggctcctggtcctcaatagcattgatatccacaccaatctcattgagagcctccttgacctccttgtatgctgagaggtttataaggttgttgccgagagctcttcccatcaaaaactccatggacatatagtaaacaacctttggatcgtccttgtccatcactctctgtgtggcaatccactcatccatgatgacatcctttacggcctctgatacagcctgataaagttcctgctgtgtggcatcatctatagtcttacgatatttattttttaaattgtctgatacagtcttaataaacacctttttgctaaacgtattatctctcatcatattcctccttatggcactaaaagggagcaaattaatgctccctctcgtgcagagattattgtttttcaactgcaagcttaacagcctcaccattaatcttccaatccttttcatagcccttaagttcgcctgatttaattgatacggcaagaacctcggtcttgatttcatcaccaaacttttcaaatacatttgaaagcttctcatctgcctcgtatgtcacagcgatgtgatccataacctcaaagcctgcgtccttacgcattgtctggatcttactgatgatttctcttacgaaaccttcctcgataagctcaggagtgaggttggtgtcaagaacaacggttatattgttgtcagactgtgtcacatagccctccatctgagtcatctcgataagtaaatcctctttagataatacaacttcatcgctaatgctgtcaagcttgagagagccggtgctgttaagctcctccatggccttatgaccatcaagctcagctaaaactgccttaatctggccaaggaatttaccatacttaggacccactgttctaagctgtggcttgaatttgtaggtggtgtagtgtgatacatcatcagtgaactcaacctcttttacgttgagctcgtctgcgatgatatccacataaaattcatccagtttttccggagcctttacaaacatttttccgattggctgacggtttttgatatttgcctcgttacggcatgcacgtccgagtactacaacctttagtacctcatccatatcagcttcgagctttttgtcaatcagcttctcatcaactacaggatagtcgcacagatgaattgactccggtgcgctcttgtcgatagagcagacaagatttctgtagatatcctctgtcatgaaaggaatcataggtgctgccgcctttgatatggtgacaagtgctgtataaagtgtcatgtatgcgtttatcttgtcctgctccatgccctttgcccagaaacgctcacggctgcggcgtacataccagttacttaagtcgtctacgaactcctgaaggtactttgccgcctccggaatcttgtagtttgacaggcactcatccacgcctgccactgctgagttgagctttgaaagaatccacttgtccattactgcaagcttatcatactcaaggctgtattttgtagcatcaaaattgtcgatatttgcataaagcacgaagaatgcgtatgtgttccagagtgttcccataaacttacgctgtccctcaagcacgagctttcctgaaaacttctttggaatccatggagctgatgctgtgtagaaataccatctgatggcatctgcaccgtatgtctcaagtgcatcaaacggatctaccgcgttgccctttgacttggacatcttctgtccgttctcatcctgtacgtgtccaagcacgatgacattctcataaggagccttgttgaaaaggagtgtagactcagccatgagtgaatggaaccatccacgtgtctggtcaactgcctctgagataaacttggctgggaactgcttctcaaatacttccttgttctcgaatggatagtggtgctgtgcaaatggcatggctcctgaatcaaaccagcagtcaagtacctcaggtacacggtgcatatccttgccacactcaggacacttgattgtcacagcatcgatgtatggtctgtgaagctctacctctgctgcctttggatctcctgctttttcggcgagctctgcacggcttccgatacactctctgtgtccgcattcacactcccagatattgagtggtgtgccccagtaacggttacgtgagatagcccaatcctgtatattctcaagccagtttccgaaacgtcctgaaccgatagactcaggtatccagtttactgtattgttgtttctgataaggtcatcctttactgcagtctccttgatgtaccatgactctcttgcgtagtagataagaggcttgtcacatctccagcagtgtggatactcatgctcaaatttcggagcatcgaagagctgctttctgccgcttaagtcctttaatacctcaggatctgcatcctttacccacataccggcaaacggagtctcggctgtaagctctcccttgtcgtttacaaactgtacaaatggaagatcataatttcttccgacattggcatcatcctcaccaaatgcaggagcgatatgaacaattcctgtaccgtctgacatagtaacatatgtgtcacatgtcacgaaaaagcccttcttgccctgcttatcggcaacctgcttagcgcagtcataaagtggctcatactccttgtactcaagatcctttcctttgtatgtctcaagcacctcatatgccttcttgcctgcctctgcgtcctcttttgaaagaagctgtgagagcaccttgtctgcaagtgcctctgccatataatatgtgtagccatcaacagcctttacctttacatatgtgtcattagggttcacacagagtgccacgttgcttggaagtgtccatggagttgttgtccatgcgaggaaatatgcatcctctcctactaccttaaaacgtactactgctgatttttctttaactgtcttgtagccctgtgccacctcctgtgcagaaagcggtgttccacaacgaggacagtaaggaacaatcttaaagcccttgtaaagaaggcccttgttccagatttccttgagagcccaccactctgactcaatgaaattgtcgtcatatgtgacgtatggattgtccatatcagcccagaaacctactgtgttggagaaatcctcccacatacccttgtatttccatacagactctttacacttcttgatgaacggctcaagtccgtagttctcaatctgatccttgccgtcaaggccaagaagcttctccacctcaatctcaacaggaagtccgtgtgtatcccagcctgctttacgtggcacatatttgcccttcatggtctggaatcttggaatcatatcctttatggtacgtgtctcaacatgtccgatgtgaggctttccgtttgctgtaggaggtccatcatagaatgtgtatgtctctccttcttttctgttttccatagattttctgaagatattgttctctctccagaactgctctgtcttcttctctcgttcaacgaagttcatattggtgtcaactttgttgtacatgactatctctccttattctatattgttcgtgaacatcccaacatgcacctcaaattcgactcttacgaggcttccttgtggcttactccactagaattttcggtttatggaatattcacaaaaaaaggcacacattcctgtaattaggaacgcgtgcctgatacgtctataccacctattacaatgtacttaagggaaatacccttgcatacccgcccctgtaacgtagggaatacgtcagaacctactctcgcaacgctgtatggcgattttagcctgcggctcagaagtgattttcaaaacggctctactcataccggctctcacctgccccggctctctttgactttcctgccatctctactgtcttcgtcactgccttttactaactgtgtttaagtatataactgaaaagccactgttgtcaagatgtaattgattctgtaataatttgataataattaactctaataaatgccatcataatcaaaattctgataatcaaaatcatcataatcataagaatcataatcataatcgtaatcctcataggaatcgtcatcattataatactcatagccctcatcaaagcccctcatgaactccttttctaaatctgtgcttacatttgcgcctgccacaacccagaatatgatgctgactataactgagatggctgctgttgctataccaactataccaaacaccttgttgttgccctttatgatatgtataataccaaaaatgatagcaagcagagctgtcacataattgatgcatgtacaaaacagtacaatagatgcgattccaagtaccagagaagctataccaaagccattgctgttctttggcggctggttgtatggattagctccatactgtggctgattgtagactgtctgtccgtatgcggtctgattgtagccaccctgtccgtttggctgctggccatactgcgtctgtccgtaagctgactgattaaatgagccctgagcatatgtgttctggttgtatgtaccctgggcatttggattctgattgtatgcaccctgggcatttggattctgattgtatgtaccctgatttgcataaccatatgcactgcccggattattgacatatccgtctgtgttgcctgtctggtctgatgactgtccatgtgcattcccactttcctgctgggatacagactgattatatgtgtctgtcggctgactgtatgtgtctgagccatttgctgttcctgaaggctgaccgaatacacctgtattgtccggtgtgcctgacgaccggttgtcattgttcatataattgttatcgtccataacttcctccatatatcctattgtttatgtagccattgtgttattgtgttagaaatattttatcatatattacaataatgtaaatatttttatcataaaaaatatataaaaatggcaggagcaaatgcgctcctgccgtaaaaaacatattactgctcttagaaatcaaatttctgactaagctcttcctcactctcctcaacagagtttttgaggtcatccgcaagcatatagatattttccagtaccttcttgcactttgccatgctctcgactgtggtatcagccatgcgaagtccctctgttgaagaagctgcgacctcttctcctgtagctgaaaggtgtgtgatattgtctgatatgactgttgttgaatcaagaatctttttgatactctcctcagccacattgatatccttcatcaacagctcaacggcctctcccatggcattaaacttgtctcttgtatcgtcgataagctcattctgcttctctaccgatgatactgagttctcgatactctcgttggcacgccttgtgtcctcattgagcttgtttataatctctgtaatattggctgatgcatcctttgtctgctctgagagctgtctgatttcatctgcaactaccgcaaagccctttcctgcttcacctgccctggccgcctcaattgaagcattgagagcaagcagatttgtctggttagaaatattgataatcgactcaacaaagctctttacttcctctaccttagctgtaagactctggataactgacactgtaacattgcttgcctctgccacgttgtgtgcctgctccttgagttcttccacaacatcagctccctgctttacggtctcatcagtctggcgtgaggcatctatcatagccttgattccactttctgcattgtctgtatttccctgaatatcaacacacatagctgcctgcttctggatagcctccgcagtgctctctgtgctgtctgctatctcctggattgaactatggctcaccgcaacagactcatcgagatcatttaacatggtcatagcctcgtcaaagtgctttgaaatattctccgcaaccattaccatcttcttattgctgtccacctgtgccatagcagattctttgatttcttccatattttcatcgaagaaatgggtaagaagaatcgtgatgctgtctgacgcatatcccacaagtacaagtacaaaaactgctatcacatcattctgaagaactgtaccccctattccaagctgcattacaagcctgatgacgctggatatgattattactgcgttcatcaccatcatcatctttatatccagatatatcatcgctgcaataacaagcggcagggcatatgtccatgtaccgattgttgaattgatcagtgcgataataaaatatcctgctgtcatggcgcttacaagtataagcgcacctgttctgctgtctctttttgtaataaatgcaattacagctattactattactgctattgccgcaacaagctgtatacttatcctggtaatatcagcatcttttgtcccaactgctgcaaataacgtaaatgctatatatgcaaatactatgattaccgccaggaatacacgtttgttggctctgttatactgttgactattcataaaatcccccttcttttgtttgagtttttagagtagctttattatacaacatttttttataataatccactactatttagtgccaacgtaccatttttctcattttgctcctgatttgaagaaaattctcctttcaaataaacatttacacaaaaacacccggcagttatcctgccgggcatcctgtaaaaaaatatttattctttaactccaccaagtgtaagtcctgtaacaaagtatttctgtaaaaacgggtaaatacatatgatcggaagcattgttacaattgttgctgcggcacgaactgaggtaggtgtaactgcgcctacagcatttttcaatgtttctgctgatcctccctgatttgttacagctgaaagaagcttcataagctcatactgtaatgtagtaagctttgtactcatacggttataaagcattgcatcaaaccatgagttccactgtcctactgctacgaataaagctactgtcgcatataccggtttgcagagaggggaataaatcttcagaaaaatggtggtatatcctgcaccgtcaagctgcgctgactcctctaagctgtcaggaattccattcatataggttctgataacgagcatattaaacgcactgaccattccagggactacataaacccaaaaactattggtaagcccaagtcccttgtacaggaggaagacagggattaatccaccattgacatacattgtgataacccaaaacatggataaacctcttttgaacaaaaatctttttctgctgattataaaagcaaggattgcatttgccaccagtgctaagactgttccaattattgttctggcaacagtaatatatgctcctgttataagattatctttttgtaaaaccgttatataattcttccaggtaaactttcttggtaagaggtaaattccacctcttaatgcatctgtaccatcattaagcgatatcgcaagtgtattaagcaccggataaagcgttatgatcacaaacagtaccataatgatgccatttacaattggaaatatacttatcttctttttctttttgctctttacagagcctgctgttatatctgccatcgtacaagacctccttaaaacaactgctcttcaccattatgtttggcaattctatttgcaataaatataagaattatacttaccacactcttgaatatacctgctgcggtacctattgcataatctccctggcttatgccccatttaagtacataaatatcaatagtctgtgatacatcctgtaccaggccgtttcctaagagatactgtatctcaaatcctgcatttaaaacattacctacattcataagaagaaggattataatagttggtttgattcccggcagtgttacatacttgatctttgcccagcgtcccgctccatcaatagatgctgcttcgtaaagtgaaggatctattgatgtaatggctgcaagatatatgattgcattccatcctgtttctttccatacattggcaaatgccactatcggccagaaatatcccggatgtgcgaaaaagtttatcggttggtctataatatgcatatttacaaggaactcatttacaatacctgttcctgaaagcatatcgtgtaaaatacctgttacaatgatccatgaaaggaaatgtggaagatatgatatagtctgtactactttctttccaccctttgatgcaatctcattcagtaagattgcaaatacaatggctgtgacaaaagttacaaccagattgataacacccattgcaagtgtatttcttataacacggataaatgtcatatccgagaacagcatcttgaatttgtccaatccaacaaatgcagaatggaatataccaagtcttggtttgtaatcctgaaatgccattgcccagccagcgagtggtagataatagaatacaactccatatgccaccattattgctgcccagaacagcagcactttctgacgtttgacttctttccatgtaatttttgttctaggttctctgaccttttcttttttgttttttctcgttaatgacatgacaccactccttaaaggcagcaggcagataaaacgctattatatctgcctgccttaaatttcatttaagctttatttgaatttagcagcctgctctaatcttgtatcaagctcggtctgtaattcacccaggaaatcctgtggattgcatgcattgtattcatccatgtatgtattccattcactatcaaagtcttttgccataacaacctttggaagagccttatgcttaagttcgccaatctttgtccaggctactccaccaggagtgcttgtgttaaagttgttagagaatgaccacatcggataccagtctccaggtgcatcgtttgttccaagcatttcaacgtatgtcttaacaccataggcatcgaaagcctcttgtacatcactgttaagaccatcatagaactctcttgcctgtccatcaggtttgttggcattgattccatcatcacttgttccactgtactgtgggaagtatgagtatgagcaaaaatgagaggccttgtatgctgtatcagaagccttctttctctcatctgctgttttgtaaaactcaccattctcatctacttcatagtcagtacccttgacaccccagaatctgagattgtggatatcctgatcaagaagatcatttacaaacttcatggccgcatctacatcatcacaggatgttgtaacagcaagacctgttgactcgttgaaagcgccgcctgcattgtgccactgattgtcacggccgtcaattgttacaggtaccggaatgtaatcgcatccctgctcatcaagacctgcctgtttaattgcatcacctgctgtgtatgcaaaatcccaccactggtcaatcattccaagtacacgtcctgtagaaagcttagagatatattcatcatatgtctgtgtgaatgactcaggatctacaattcccttctgatactcttcattgagcttcttgaaatatttaactgctgtatctgatgtattatagtcaagtattttctttgtatcaggatctaccatacatgatccatcgtttggatatccgtcaaggaactgtggtgcattctcaagacagaaatatctccagtcatcacaaaggattgtatatggaatattttctgttccatcagccattgttggatttgcctcattatatttctcgatgaggtcaaaatactgatccagtgtcttgatctccggatagttagcccatttaagtactcttgcctggatccagaatgcctcgtcattgtgtgtgcagactttctcgtctccctttatgcagctaaactgtggtatccaatagatatgtccgtcatcctgacgaagtttttcccactcaagatctgtgaaaagatttttgatgtttggatatttctcgatgtagtcatccagtggaacaagtgcgcctgcatcatataactgcatctgtccgcttgcaccttcaatgaaatcaggatattcgccacctgcgatcattgttccgattgcctcatctgctgtctgtccggtaagccaggtttcatttacccttacacctgtcttttcctcgatgatcttctggatttcattatcatcattcatttcagatcccggtacagcaaagaatgcatcaaactctttcgcgcttccagtttcagtgccaccttttttgccactatcattgccacatccggcaaacagtgttgctgccatggtagtcacaagcagcatgcttacaattttttttcttctcatattgtaatgtcctcccttttgataacttaattttatactttttaagttttcaaacaatcggagtaactatagtcaaaaacagggtaaactatagtttctagaaaaaactataatttaccctgttttgcagtaatatatattattctccactttgcatctggcgtctgaagcgcgccggtgtgcagccttttacctgtataaacctgttcacaaaataatccatatcatgatatccgacttcctctgctatctgtattatcttcttatcagtcctaagcagaagctctgccgcccgttccatcctgtaattgttcagataatccttaaaggactgtccgtatttttttctgaaaagctgccctaagtatgcactgtttacataatacttctcactcaggctcttaagcgtgatgttcgtggcataattgtctcttacttccttttctaccatgccgatcacacctcttgacacattttttctaagctgcgacagataatcaccatactcacagcaaaatctggtcatatgcgcacggcttcccctctcaataccggtcttaaagctgctctcacttatgagtcgcaaaatctcctgctgatttacattatcatcctgctcacttgccaggtgtatgaactgaaacaacagataattaatatttaagttcatgctttccccattcatacccatgctggacatctcatcataaaatttggcaactgcatttcttatctcaagatggttattctgttccactgtcctaagcagcttatcaagactatctttacaaagcactattccatctgccgatatctttacttcatcctcatagtaatatatgctctttactatgcgaaagccctgaaacgacctgagcatacatgcattgccgtatgacctggctatctttgatatatctgatacttttcttccgaccagcataactatattcttttgtgtattatcacatatataccttctcagatcctccagatattttctctcggtttttgcggcttcctctgccatataatctgagaatataaagcctatgtcatacactttttcatttaccgatacatcaaatacacaatgtgccgaatcagcccccagaaaagcaacacagctttcgtacatcttgcgctgtaagcttctcatatcactatcgagtatctcatcacctgccggaagctgctccatctgtatttcaacataccttgctccaccctcacacctcatattttcttttacatagttcaggtttacttcatcatatttgccctgtatcagagatatcaggtgtcttgcaaggtatgcctgtttcatctttttgttatcctcgttgatctggtttttctcgtttttgagcacaagaaccttgtttagtaccttaagcagcatctccttatccaccggctttagtatgtaatccgtacagtcattctgcatggcctgctgcgcatagctaaaatctgcataaccgcttaatatcacaaaatacacatctgattttttatcttttctcaaagtctcaagcagctcaagtcctgtcatctccggcatccttatatcggctatgaccagatccacattctcattttccagaaactgcagggcttcctttccatttgaagccgttcctgctatctcaaattcttcattttcccaatcaatgagcaccttaagcccctgtattatgaaaggctcatcatccaccaataatactttaagcattttaaatctccctataaatatgtttccggtatttttatcatcacagtcgtaccgcagccttcctcactgtccacatcaaatactgctttagattccgttaccattttgatacgcaggcaggcatttatcacacccactctgccaccggtctttaacatatcgatatctgcatttttcatgttacttttcattttttcaagagcatccggatcaattccgctacctgtatcctcaacctctatatgcatgaacccggcttttttgaatatacgcacaaatatccagcccggagcagctttactttctatgccatgcacacaggcattttcaacaaaggttacaagcgtaagttttggcacctgacattccatgcagtctgcttctatatctatgttatagttcagtcgctcgccaaaccggtatttctgcaatgccagataggcttttacaaattcacattcctttgcaacggttacagcatcatttccccactccacatactgtctttgcatgatggcgagtttttcgaccatatcagccgtctcattttcctttttcagcagactgtgcattcgtatgctctcaagcgcattaaacagaaagtgcggatttatctggctgtgcagtgcaagaagctctgcgtttttctgacttacaagcatctcctgctcttttagcttattcttatatacagtctggatcaagtcatttgtgcggcttaccatcctgttgtaattttttatcatgctgccgatctcatctttgctctccctgtcagtcatagatacaagcttttcgctgtcaactgacttaaatacctttgaaagctgtaatatcctgctcgtaaaggaatggttaaagatactgaacagacaaagtggaaagaatacatttataagcatcagaaaaacaataatcggtgcattgtgcataagcatgctccatatattactgcgtgtcttaaacacatatatatcaagatcacagccatacaaagagagcttctgcctgtatacggagtcgcttattttcccaatctcctccaatgtcttaaatggtttgttgactccactgtaggccccatttgacagcactatgtcatctccatggcagataagcacttcattatcataattcatattcttaaaagtacgcatcatgctgccataattaaactctatcttgagtaccttttcgatatcagatgagtaaaaatccagctttttcatataaatcatatgtctttcatctgacaatccggctacgcctttttcatatacaaaaaagagtcctccgctttccttctgctccagaagtctgtaagaatccgtatttcttacagcagacatatcatttacttttccgccatttactattgtaggattgtcagcatacagaaaaaatactatattgctcattccaagtgtgttttcaaaaagtgtatcctgaaagaagctctgatactctgatacatactcagcagagcttgtgtattcctttgatataaaatcgtctatgcgcttgctggtgtagatactcttagctgcctcttctgcgttattgaccatgctgttcagattatatcccacagcacttgctatgctcgacatttcatgtctgctgctttctttttcagcattttctacgatggaaagcaccactgcatcagtcactatgagcggcagcatgacacaaagtacataaaatatgtagaatttttttctgagtgaataatcatcaagctttctctcaatggcattccatattgattttctcataaacagttcctctgaaatcacttaaaggagccgacatatgcccgctcctaaagtctgttttaacttatcattaattataaaataacatatttattattaataatctacccctgttttctctccacatcttgcgatttcaatgcgctctgtcctcttgcctgtgagctttgtacttctgtcatcaggctgctgtcctcctgcggatatctcataaattcccggcacagctacacagcttccatcctcttctatcacagcaaagtcccttggcgaaagagtcagctttactttcttagtctcatgtggctcaagctttacaacctcaatcccctttagctgatatcccggctcatactctgcagcatcaacgtgcctgatatagaactgaactatctcatttacagtatatctgctgtcatttgtcacatttacaaacacctcgacaggttcgtttacatcactttctgctttatccactgacagtccatcatagtttgtctcaccataatgcagtccatatccaaatggatataacacattctcatttgtatagcggtatgtcctgtgagccattgaataatccgtaaactccgggagattttcggtgccctgataaaatgtaaccggcagttttccactcggactatactctccgaatatagcttccgcaacagcctttccgcctctggctccaggataccagctgtctataatggcatccacatgctcttctgcccaggaaagatctatcgcacttcctgctgacagcacaagtactaccggctttcctactgctgcaacagcctctaaaagttcctcctgaagtcccggaagcataagccccagcttgtcaccgcttgcatattcatttccggcatcaccctcttcaccttctatagttgcatcaagtccaagacacattacgaccacatctgactgttctgccatgatgagtgcttccttaaatctgtccttttcctctgcaagtccctgtactttgtccttgtacagatggcagccctctgcataaagcactcttgtatcctctccaagatattgctgtaatccctcaagtggagtgatatatcttgatgaggtaccataataatttcctataagcgcatccctggagttggcatttggtccgataaccgcaatagttttaacattttttctgtcgagaggcaggaaattgtccttattctttaaaagtacaagacttcttctggcagcctccacagaaagctccacatgctccttacattctacaacctcatacgatatgtcctcatatggcgatggataatccttcatcatgcccagacggatacgcacctccatcagcctttctactgctgccgtgatcgcctcgtctgaaaccagtcccttgtcataagcatccttaagatgtaaaaatgcacttccacagtttaagtcacagccgttgtttacagccatagcagccgattcctcaactgtatccgtcacatgatggtgttcgtggaaatcaagtattgcccagcagtctgacaccacatgaccttcaaatccaaactcgtcacgcagtatatccttaagcagtgtcctgcttccgcaggcaggttctccatttaccctgttgtaagcccccatgacagcctcaacctttgcatcctttacacatcgcttgaaggcatacaaatatgtatcatacatatcatgctttgatgctttcgcatcaaactcatgtcttatggcttccggaccgctgtgtaccgcaaaatgctttgcacaggctgccgattttaagtgatccggatcatctccctgcaatccccttatatatgcgcagccaagcttacctgtcaggtacggatcttccccgtatgtctcatgtcccctgccccatcttggatctctgaatatatttacattaggtgcccagaaggtaagtcccttgtatattccgtgatcacccttttttgaaaattcattgaactttccacgaccctccgttgatacaacatctcctatcttttctatcaggtcagtatcaaaagttgccgcaagacctatcgcctgaggaaatactgtagcaacaccggcccttgctactccatgaagagcctcattccaccagttgtattccggtatccccagtctttctatagccggtgactcatacagcatctgacttatcttctcatctattgtcatctgcgatactagtttttttgcatattctatagtttttttactcatagtgacttctcctttaatttatataatgattttaccagattcatgcagtattttctttctaattgttgccccacaatgttcaaaaattgctatttgtgctataataactatattcacgcaaatgcgcataaatatcagccgtatggagacaagtatatatgatcgaaaatctgaatggaatacatgagacagtaaaatataaagaaaacagcaatgtaaagctttttataaatacggaagcagaagattatcccattcactggcacactcccatggagattatcatgccgcttgaaggcggctatacagtgcagattggggatgatctggtacatcttaatgagagtgatattatctttataacttccggtgtaacacacaggcttatcgcacctgacaccggaaaaaggcttatcctgcagattgagtggtctgctgtctcaaaaataaaggaatttaattccatacttacccttatagcacctgctataacgctaaccccggaaacttccggtgatatccacagcaatatccgtaaactgttgcttgatatatcagatgaataccagaccgactcattcctatcagaagccgtgatctactccaaaatgcttgaagtacttgtccttattggaagacatcatactgccagcagttgtaattttaatgtcggcagacacaaacagcaggaatatctggagcgttttctgtctatctgtgagtatatcgatacacattgcactgaggacataacacttgatgaaatctcaaaaatagccggattcagtaaatatcactttacccggctatttaagcagtttaccaataataccttttacaaatacttaaatcagaaaagaatagagcttgccctgacccttctggctgatcccaatatatctgtcaccgagactgcaatgcagtcaggctttgcaaatccatccactttcataagggtgttcaaagctgaaaagggctgcaccccgactgaattccgcaaaatgtttactgggtgagcattatgtatgaaaattctgcatagttattactattgctgccatttgaggatgcatacataccgaccgtacagcccacaaagccacctgcttcttctgtggtatatggcagcagacttattttttctgcgacttttacgctcttttcggccgtacctatccatatagatgcttcctgttccttacagatcatacatatattccacagtggatttttttctgtaatgctgtactccataatatctgccactgctatctttttgtcagttcccttaatatgtgtagtcaccacaaataccagcctcccggcttccattgttatctcagcgcgaagatgattctcattgttctggaaaagtacaagtcctgccgtctcattatccgactgtgggataaaacgcactgctgtctttaccgtaaactcatagcccttctgtcttagtccaagaaatgcgcttgtgccaagatcagtgatctgctctttgtttgtgtacagtctcagtactcctggattttccttaagggaataaaaagactcgttgcgttttcctattccaaccagcctcttatcaggcttggcttcgcagaaagttataaaatcattttctgatatctcatctataaatctgcactcttcaagcggtatatctaccgtatcctcaaggtgtcctatcccgggtgctattaccggccattcgttttcccatattgtttttgcaataaaggtttccctgcccatgctgctgtgctttttgcatggtcttgacgcaagcatgaccacataccagtttccgtttatatcatccaccagatcaccatgtcctgcatagatgaccggataatccatccccagatttctgtgtgtaaatatcggatttctcggacatccttcaaaccatttaaaaagctccgtgcttcttgctatcgttatactgtgctccggtccggtgccgccctctgcatgcatcagataataatatccgtttatcttgtagatatgtggtccttccggccatatgcagccctttacagcacctttccatatggccatgctcctgcccttaagcttcatggttccaagatcaagctcctgtatccatatctcccagtctccattgtagcgtactccttcagggtttgggcgtgtgccacagtaataacatctgccgtcatcatcaaagaaaaggcttgggtctattccgactgcttcttctcccaaataatacggatcagaccacggtcctgcgggatcctgcgctgtcactataaaattgccgccatgcgatacattggtcgttatcatataaaaagttccttcatgatatcttatggtcggtgcaaaaatacctctcgatatttcttcattttccacgcatagctgcgatggtctgtcaagtatattgccaatctgctcccaatgagccagatcccggctatgaaatatgggaacacccggtgcatacacaaagcttgatgtcaccagataatagtcttccccgactctacatattgatggatcaggataaaaacctgaaagtattggattttttgctgttaccatgtctcttacctctcatttcctataatacatatccaaagcccagtatcgtaaactgcttgtctctgtcttcttctgcaatttcaattcttacaacatgattttcactggtcttattgttaaatattattaccgcattgcaatgctgccagttattgatatgtggatcagccgtaaaatgatattctccgtccacatataccttcgcctttcccacgtttacctctcccgaatccttaaatacaaggagaagtgccctgcactccatctcaagctcgaaatacgcttttaccctgtttaatgtattttttgtgccatcatacatccagttatacgggaattccggagtcagcgaaagctgagcatccatctcaacgctttgcagctgtgtatctgtcgaatcgaagccaccctcgtcaatatatgcctttgcatatatatcctttttgtcgagcagtcttatattttcaaagctgtttcctattaccggtgcaagatttagtttttcctgcaatattttttcctctgtcagtcccagttcaaatgcatccaaacttgcatgccctgcctgatctattttttcaaaaagatactctatgcagtctgccatgacggaatggcctgcattgcccggatgaaacatatcatagaaaaactgatttttggttattacccttccctcgtcattttttaatgcaaactgaggggaaaccgcatccagcacgcttaccataggcagatcatagagctttccaaccgggcttaggcggtcttgaaggttccagtcatttgcaaatactgaaaaaagcaatatgactgccggtttacatggcagattaagtactttacgtacaaggctttcatagcagtcaccctttgtctcatctccctcatcatttacagcaaattcaataactactatatcaggttgctgtccgtctcttagtacatccctgtcaaatctgatcattcccagctccgatggcgtgccacccacaccggcttttatgaatttcacattattctttgcggaaaaacgcttctggaaaagctgataggatttgtatgcgtagcactctgtatttataggtgccgcacctgctccctgtgtgatagatccacctatgtatgcaagtgttacctcttttccggctctagtcttttcgatggcttttcttatgcgatatgcatttcccatattcataagcgaatggcttatcatcctgcagtattcatcagagttcatatccacctctgtttcctcaatatctgccggagcctcatagccgtcattcagatacagtctgacactcgcttttcccatgatatccggtgtattaaatatgaactttatctgtcccggtatatcatcatccggtgtccacttataatctgacaggtatatctttttctccattccatcgcctgtcagctttaccttaagattagtaccgcctccgtacaggtcctgctttccgtacatctgaaacacaaattcgatctgttcgttttgattatctgtttccacagatacacctatgctgtgtacaagcctgccaaaaccttccactgtctctaacagtcccagttcctctttattttctatatttccggctatctgtgcactgtttatcagtcttccgtcgctttcatatataaaatgtataatgcttccatcttcctgtactgagccgtatatatccttatccttcatgatgtagaaataaggtctttttctttccggatcctttggtgcttttggccctgccatcttgctgcctccttgttgtgtcaattttatcagctataatgattatatgatacaaaaactcccggtgctttgcaccgggagaaattatagatatttgtcctgtcttttatagtttatgactgcttcatcattccagcttaaggttcttgtatattaaaatcaataaatcctgtaatttcctgaaagtgctaacattgcaaacatgtaaaggaaattgtcatagtatctcctgtcaccggtcctaagcggagtgttccagaacttttcaacacattgctttgcatattttccatctgctgcgagtgaagcttctgcattaacagcaatgattgctaccggatgaagtgccttctcatcaagcggtgtaccatctataagaaataccccatcccaattgtccttctgatcctcacaataaaacttctgaaggttttctgccgttttaatctgccacggatctgcatcaaaccacagatgatccatcgctatattggcgatcgtgcggtatgcatcactgtaataccagtcatgtcttccaaatatttccttatgacccgtatgaggctttccgtcataatctgcatattctgcgctaagtcctgtcttttcatggcatgcactgtgcagatatgctctgctggcagctgctgcttctttccagaagtcccggtcctcctcataagccctttgggcaaaaagttcataaaaatgcggcagatggtatgaaggatcactgaaatccatatttgtgacaaactttatcagcttgttggaaggctcccacattggctctccgctgtgtcccggctcacccttgtgtacacactcccttaagatattttgtgcctctttgctgtagcagaatataccatcgccatctccccatcttttagaggcgaaaaacaatgccattgcaaaatactcttcaccatcaggtgccggtccatcggcatttcgctttccgtttgtctgacatgaccacgcaaaataattttttgccggaccatcttctatgtacatatatgtgcgcacccatttccacagtctgtcaaactctgcttttttatccagctgtacacataccatcatgccatatgacattccctcggttctcacatcatgattgccggtatcctccatatatcccatatcatcaccggcttcatgataaaaacgttcatcatcattcccatagaatatcgtgttaaaagtatcctctactcttttttgaatttcttcttccggatacccatactccttgaatatatttctgtatttgcctgtcttatatgctcctgccatttttctctcctttttgtcgctgttttactgtatcccgcacatgaaatttacaaatctgtgtctgcatgatgtccaggattcattatctccttttttgaaccattctttctgtgcactgcccttaattccgtatatggctgttatgttcccgatgatatcatcagatatcgtgctgtctgccattattatcataattccttttatcctgccttcgccagacagattatccatgatatttgctatctttcaataatgcattgcccagtggaaatctttaatatttgccgaaaatccaccctgcatatcaggctttaactgtatgcgttctgagctgaaatagcctcccattccggctacttctactttattggcatttggcgcataaatataaaaagtaacacttccatcatcctcaagtgtgaccgagcatctgttattgtccattgatgatggtatcgtgcctatatacaaagcaccattttttaaatcatccaaaataaaatccccccattcgtttattgatatatacaagtgtaaacgaacaggggcttgttattctattaataaattgccaaacagtattcaaatattgctaattttcatttaccttttgctgtaaataatcaaaatatatctgtggattgcaggcattgtactcctccatatattgctcccaggcagcatcaaaatcatctgccatgataacctgcggcaaccatattttctttactgccacaatattattctttactttcccacattcagaggtcaaaggaattgaatctgaatatgaatacatcggataccacgagccgggagcctcattttttccaagcatatctacatagttttccactccataggctttaaaacattcctgaatatccacaggctgatttctgaaaaactcgtcctgctgaaactccattgaaaacgcatttataccatcatcaagcattccctccactcttggaaagtatgagtacgaacacatatgcgctgtccgatatgagctgtcactttttttctctgcctgctcattggtaaggtaaaacaaaccgttttcatcgactgaatagtccttgccctcctctccccagaacctttctcttatgatatcaggttccagaagatcactgataaacttcatcgcaccttcaatatctttacaggaggtggtaatggacactcctgaagaataatctatttctgccatcctgtttgtatgccatctgttgtgaataccatcatcaatcgtgacaggaagaggaacataatcacacccaagctgtgccagattctgttttttgaatacaggatctattacataataaaactgccaccactggtcgaccatcccaagcacagctcctgttgacagcttatccagatattgatcataggtggcattaaacgccccgggatccattattcccttacggaactcttcgttaagctttccgaaatatcttttggctgtgtcggtcacattgtaatccatcacttttttggtttccgtgtctaccatacagcttccatcgtttggaaatccgtccagaaactgcggcacattttcaaggcaaaaataccgccagtcatcacaaagcatcgtaaatggtatattttctgttccatccggcattgttggatttgcctgtacatagctttctatcaggtcaaagtactgctctatcgttgtaatctttggatatccagcccattttaatactcttgtctgaatccagaaggcttcaccattatgcagcatctccacatcatccccatgtgatattccaaacggtggaatccaatatatgtgtccatccggctgtcttaacttttcccattgttcatcactgagatattcttttatgttcggataatcgtcccagtattcatctattggaatgagtgcatctgcctcatacagcgcagtctcacccaatacaaaatccggatattccccggttgctatgagagaatttattgcatcgtccttatcctgtccaacaagccatgtttcctcacattcagcaccgatctgctctgctatgagctgctttatatcattatccggatctatattatctccttctacagaaaaaaaagccgtaaaatgctttatttcttttttatctgacgctttaaaagtaacaccggctataagtccgataaacaatgccactgtaatcgctgcggaaaccaatctttttttcataccatgttttctccctattttcttttgttcagtctctgctataaaattgcataatagtcattatattccataaaaaatatttttacaaatcctaaaataaatatatctaataactagggtataaaacaataatttatcctgctgacattttctctgtcatacattataatttctataattttaaaaatcaggaggaccatataatgatcatacatgaaataacagaagaatgttttaagaaatatggaaaggtgatcgactctatagatcttacagagctggtcagcacaatgcagacagtagaaattcctgccgatgtggtttatgagccatccatttctgcacttgaaaagctaaaatgcgctacagaattacaacagaaaacatatggggagcttcctatacagataggctggtgcataggcaacaatcataagctcaatgctgttgaatatcacagatgctctgaggtcaatattgccgcaactgatgccatactgatactcggccgacagcaggatatctccgtggaaaatacatatgatacctctttgatggaagctttcaggattccttccggaacagcagtcgagctttatgccacaacactgcactacgcaccgtgtaatgcatctgatggcggatttctggtagccgttgtacttccaaaaggcacaaatgaagccctggaacatccacacaccggcggagaagatgctcttcttgcagctaaaaacaaatggctcataggacatcctgaaggtggacttcctgagggatcatacatagggcttacaggtaaaaatctggaaattaaatagcaatcaaaaacagcccgggctttcacccgggcaattattatattacgctttaactttatgataaaattaaaccttcgcctcgtcctcgttgtctccccagaaatccaccggctcatagtcctgcagctttgcaagaaagcccttctgcttaagctcctcctgtatggcatcaagcacctcttcactctccgcacatattgtgtgatagtgataacctgaagttacatttttaagaaggctggactttcctgtacggatttcctccaggtaatttctgacatcacgtctggacttgatgtccatattggcgcggatcactccgtagaccttgtggtatacaaatacgtccttcacatggcctccggcatcaactattgttgaaagctcctcctctacttcatcatcctcgtgaaccacctttaatactctcgaatactgcttatccgcctgtatcagatatcctctgtttgtcgaaaaaatcgcggctccgtttgctcgaagcagtgctatgtcctgcacaatcacctgacgactcacatcaagctcctttgcaagcgcaactcccgccacaggcgactttgacgaggatagaatatttattattttttttcttctctcatcaccgttcattttcgttcctttctgtaaaacattactgtcacagcatagtgcgaccggcaatctaaaatctatactgcatgtagatttttaagtgataaatccataataggcgctgaatgtgtgagcgcaccacttgatacatagtctacaccaagaccctttattcttgcaatattttctttggtaacatttcccgaaacctcgatttcggctctgccgtcaatgtagtcgatgcactgctttaaaagctctgtggacatgttgtcgagcatgataatgtcggcaccggcttcaaccgcatccttcaccatatcaaagctctctacctcaacctcaatctttctgacaaacggagcataggcctttgccatggcgattgcctcttttacaccgccagctgctccgatgtggttatccttaagaagtactccatccgagagattgtatctgtggttgtttccaccgccgactctgaccgagtatttttcaaaaattctattgtttggagttgtctttctggtatccaaaagcttgataccggtgccctctaagagcgctgcaacctgactggtatatgtggcaattccactcatgcgctgtaaataattgagcgcagttctctcaccgcacaagagtactctgatatctccgtaaaccttgccgataagctgcttattttctaccctatcgccatcctttacgtaaaactctacctttgtatctgcatcaagcagtgtgaaaactctctcaaaaacctgcagtccacagatgattccgtcctgtttgcagattaaatccacctctcctgcctgtggatgtggcatcacgctgtttgtggatacgtcctcgcttgtgatgtcctcctttaatgcgcttaatatgaatgggtctacgttgaggcccagtgttacctgatcgtacatatagttagattcctttcgttcaaattattcttatttattacggtttcgcactttttatgcctgaatataggcaatgcctgattcgacagtctcttctatacctacgctggtgcggccctctatagcctccatggctagcttcctgtattctctctctacagctttttcatcgctgtagtctgcgaggtcgatgctatctgcggcctttttggctgctatctcatcatttacaaagccaagctccgccatctgtcctgctgcacgctttgcgaataccaggctctcaagcagtgaattgcttgcaagacggtttctgccgtgcactccgttgcatgcggtctcgccgactgcatagagacattccatggatgtgcggctgtggtgattcaccttgacgccgcccatgaaatagtgctgtgccggaactacaggaataggctccttgaagacatcatatcccatctccttgcaatgttcaatgatatttggaaaatgtgatacaagctcatcccttggaatggtacgcaaatcctcccagacaaagtctgtgccgtcctttttcatctgctcacggattttgccggtcagcacgtctcttggtaagagctcatcgacaaacctgttcatattcttgtccaaaagcttagcaccctcacctcttacggactctgaaatgagaaagcttctgtcctcatgctttttcgtgtaaaaggtcgttgggtgaatctgcacatagtccgggtttttaagctctatgtcatgcttttttgcaatggcaagcgagtcacctgtcagatgtctgaaatttgttgaaaatctgtacagtcctccaactccgccacaggccatgacagtgtatgccgctgtcaccttttccagcgtgccatcctgttttctgatgacggcgccgtagcatttgttatccctttcgatgatatcaaccatcgtcgtatactccatgagtgtcacatttgaaagcttcttaacctgtgcaagcaatgtgcttgttatctcttttcctgtcacatcttcatggaaaataattctgttgtgtgaatgagctccctctctcgtataggcaagtgagccgtcatcatttctcgcaaaatctgctccgtatgaaacaagatccttaaccacctcaggggatgagtttatcattatcccaaccgactccttgtcattctcgtagtggccggcctttaaggtatcctcaaaaaagctgtcgaaatcggactgttctttaagcatgcacatgccgccctgcgccagaaatgaatcattgctctcaagatctgactttgttatcagtgtaattcttatgtctcttggaagcttaagcgcacaataaagacctgagcagccgcttcccacaataagtacatctgtattcataatatgttacctcttttatttacctgcatccaccgatgtagccgcttctttagcaacatccccctggatgcgatttactgtaatgggcgtattataacactaaaatttacaactgacaagacacctgtaaaacttttgtgttgacagctggtttacagctaagtataatgacaagtaacttatttattttggccggttctttatgtaaaatccaaaaggggcttacattgatataactgtgcttcaatcacactaggaatttcaagaggtatatcatattatgatgacaacaagagaattacaggatgagattatccgattaaagaaggaaaatgatatctgtatattagctcacgcttatcagagtcacgagatacttgaggttgccgacttcacaggcgactcatatggactcagcaagcaggctgccacagcaccacagaagaatgtgctcatgtgcggtgtccgcttcatggcagagacctgcaagattttatctcctgacaagcatgtatttttgtcaaacagcgcagccggctgtcctatggcggagcagctcgatgtagagctcttacaatcgttaaaggccgagaaccctgactatacagtggttgcctacataaacaccacatcagagcttaaaaccatatgcgatgtgtgcgtcacatcttcatccgctgtaaaaattgttaaaaatattgacaataacaagattcttttcatccctgactgcaatctgggcgcatgggttgaggaacaggttccggaaaagaccttcaaatttgtacatggtggctgtcctactcacctgcgcatgtcaatagcagatgttgagagagcaaaagcggctcatcctgctgcaaagcttctcgtacatccggagtgtcttgctgaggtttcaaaggctgctgactatatcggaagcaccaccggcatcattgactatgctaaaaacagcacagacagggaatttatcatcggaactgaaaacagcatactgcagcacttacagtatgagtgccctgaaaagagcttctatccgctctcaaaagactgcgtatgccacaatatgaagctcactaccctgatggatgtatacaattgtgttaagggagcaggcggagaagaaatcatactgcctgacgatataagaacaaaggccaaggcctgcatagataccatgctcacacttggagaataatttaattgcaatattaaaagaccacagttcatctgttttgatgccctgtggtcttttttaattaattgatgataatacttcatctgaatatctttctttaattttcatttccagcacctgaaattcatgaatataattgtcaagcaccttattcacaagctgacgtgcagcttcctcattgtatatatgagttgtatcattcctgtctcttaacattccaagccagacactctcatcaataaaatcataatacgcatatgcagtttttataatttctcttggagaacctgttgcagcctgattagcgccctcatatcgtaacagctcctttaagaccttccagcccagctcaaattgtatataatatttatcaattataccgctcacaataaaatcatttgtcaagtcttcatcaaatgcccttgacaatatcctcaagtgtctgacatactggtcaaattttttcatacaataccctcccatccctttctatttctgtcaccagtaccggtgaaatatgcttatcatccatatttattatgtccagctttagtaaagaccacaactcctcattaagacaatccgataaatcaccaaaattctcacatccataaatagccagatcaatatcacttttaggatgattcgtgcctctggcgcgtgaaccaaacagcactactttttttgtattatatttttttgctatattaacaatttgcttatatacttcatccatataatactccttatttcacatccgtctaattgaatccaacaaccttctgtgacagcttatacgcaccgatagctacctttctgcctcccttgcccggcaggttcattaactgtcccatgacgccatggcgtagcttcttgtaggtttcttcatcatgctccttcatgtatgcccacagttcatccttcttagccatgttctcatcggtgcctgagataattgccagaatagtagaaatagtcgtaataatctccagatagctgtacatatacttcctgcacatctcatttgttatctcatgcaatttgacatcgtcaaacataatcttatttacacgaatctgctggtcaatacggcgtatcatcacctgctcattgaccgactggtcatcgcgaccgataaaatatctgtagaagtccacatccagatagtacatcgtacgcacatacggaagcggcttatatacatagatattatccacataaaaggtatgctttggcagcttgagtccacagcttctcaaaagctctgtcctgtatattaccgaatgcatcagtatgtaatgccccttataaatatgctttatatcactccaggtaaatatctcattgcgcggaaagccggtctgacgcataacctttttacgctttgctccctctttctcgtagacatagttggcaagaagcatatcaatctgtgtattctcctgctcaaactcccttagcttgtccagtatcttcttgtatgaatccaaatccacccagtcatcgctgtcaacgaccttgaaatatttgcctgtggcatttttgagacctgtgtttacagcctctccatgtccaccgttctcctggtgtacagcctttactatgtcaggatattcggctgcatatctgtcagctatcgctgctgtctcatcctttgaaccgtcatcaacaataattatctccacatcatctccacccggcaggatagactctatacaatgctccatgtaatcctttgaattgtaacatgggattgcaaaacttaataatttcatctttttccccttgtaaaaaaaataatatcgctgtttgattatgcataaaattatatcctatatgcaataacaaataccgatactataattatacacaaaatcatgatattgtctaaggattttttatggtaccttaggactgcacagtttgttcatattttgtttacagaaaagtgaaattcaaaacacacggttttcacaattgatttgtatactaacatcataaacgaaagatacaaaataaaagcaacaaaacatattaattacgcaatactcatactaatctttttcatatatagccgatgcaagccacatgcatcggcttcctctttatatatcagcttctctttatcttacgtgaagccgtcttttcaaactcactctcccttactttaaggctatagatacgcttgtacgcaggtacatttacattgtactcatcaataagcgcctgcagagctggccttatatcggcgatgcctgtattttgagcatactctctgtccgggaaaatctcagcttcaatcactccttcagactcacgcactatgatttcctttatgagatgatttacgctcagagcgttttcaagctcctccggtgacacattctcaccgtttttggtgataatcagattttttcttctgccggtcagataaatatatccatcctcgtccacatagcctaagtcacccgtgtgaagccagccgtccgacagtgtctcctcagtctcctttggcatcttataatagccctgcatcacacttgtaccgcggacaaaaagctcaccgtcaactgtttttgcctcacagtttggcatcagcttgcctaccgagtttttacggatatcccagcttagatttgtgcttatgaccggagaacactccgtcatgccatagccctgcaatatggtgataccaaactctgcaaataaatcaacataatcaggatttaggtacgcaccgccactgcagattgtatgaagcctctctccaaacattttcttacggaccggctctgcaggaagtcctgctgcccttacctcctcgagctttctggcaaatgtctcaatcataagaggcaccataagaatcatgtcgggagtaaaaagctgtatattttttgccatgcgcatgatggaatcattgatgcagattaccgaacccagtgaaattcctttcagaatatccatgctcagacagtatgcatggtgtatcggaagcacagacaaaattaccgtgtgaggtccaattttcatgtcaaggcatgtggcattttcagccaggttgttctgcgtcagcatgactcccttgctctttcctgtggttccggacgtaaacatgatagtgcaaagcgcatcctctgccactgccggctcgtagcttcccctgttgtcatctataagccctttaaacgaaagcacctgtggacaatgctctgtactgttcatagacacatacacatttatatcatgacagcttttagctgcggtctcagccacatccgaacgtgcctcatcaaatataagcatcctcacactggctctgtccaaaagctcacatatatccgctgccggaagcgatgcatcgattggaaccgcaacacttccgctttctgtgattgccagatatgatactatccactcatatgatgaagggcctattacagcgatatgctgcccttttttgccaagcttttcgatggcattggcaaagctgtctgtatcattcttaagctcactgtaggttcttgactctatctcatttttggatttcttccatcttatcgcgtcatccgcgccgtaagcttcatttgcatatgaaagaatatccggaattgtgtgaaataacatatttcctcctatcttcacccattatgcgtcttttaatgtctcaagataatcgactgcttcctgtactgtgcggatttctgcagcctttgtctgctcaatctccacatcaaaggtatcctctatctccccgagcatgctcatgaagtcaaatgacgtgaagcccagatcctccataaaacgtgactcttcgtgcacatctgccggctgaacatcaacataattacagataatttccactaattcatcaaacataataatctccttttacctaatacgtttcctaatccactacactaatttaatgatttcgcctattgtaagctcagggttttctgctcccttgaacatgattttgcacaggtaatagtacatatactcaagctgctttcttgagactgccttgacctgatgctcgaagctgaaatccagtccgttgtcctccgggcggtgcattaccgttagatacatagcctgtgtagtcatgccgttcgggtaccacttagtcttgtattttatatctcccaggtcgtttaagcccttttcctttaaggtcataggctgatatgtaagcgacatcggctcatatgtaagccctgcctttggctgcggataggtctttgagcgcagtgcaaagtactctgtcgggttgtagtttgcatggcggaacagctcgttttgcttatccctgatggtatacacggcatcaataaagcgtacatcctttgaaaagcacgtcctaaacggaaacgaatgaatacgtgtgccgcctgacttcttctccttaagtgtcgcacgtctggcgatggcattgtttacggagacatcatcgaagccgttttccttctggaaaaacgtcctgattcccatgagaagcagacaagcaagcgaaatatgatatttctcgcaaaaatccataagacgctttgtcggctcagcctccagatgaaagatatcaagcgctgaggtgacatcatccgatgcattgaatgcactccttagcttgttatcatgcatcagttctcttgccgcatcaagctttgctgtgccgtcgattccgttgtagattggctccgactgtctgataagcttctcaaagaactctctgtccctaagctgtgccttacttccggcttcatatgccagatcctttttaagctgctcgatatatgagcacatatcctttggaaaaggtactccctcatacatggcattacagtatatctcaataatatcctttaaaaatgcaataagtgactgcgcatcaaccaccatgtgatgacctaagaagtacactccattgaatccatccggcatctttatcatcacgattttggtcataggagagtcctcaaactcaaacggcacctgtgtccagccttgcatctcattctctgcctcctccatggttacatccgtaaaatccttgaaatcgacagttctctctttaaaatcctcatccacatccgcaatatactgatagcactctccatccttatcccttgtaaagcggatacgcatggcctcgtttctggcatacgcgtagttaattgaatcccttagcacgttccagtcaagctccgtgccgattgtcaggcttgtacctatattgagtactgccatattcggacagtactttgcatagtacaaatgaaatttttgtgcaaccgtaatcggatatacgttgtgtccctttctcgtcttcatcatctcataactccttccaaaaatttatcaagtgcgtcctcgaaagctttcgtattcttgtaatagctctcgcagtgtcctgcaccctttactatcagctttgtcttttgtgacgcgcagcttgcataaagctcatcacacatgctgcatggcacaaatgtatccttatcaccatggataaacaaaataggcagcttcgccttttgcacctcttttgcagcattgcattcatcaagcccataccctgccatttttctgttcgcaaaatccgcaatctgaatcatcggaaaagccggcagatggtacatgctgtgaagcacatgtgtaaataccgccttaggcgaggtaaatgcacagtctgacacaattcccttcacctgctctggcagattaagtccacttgccataagcacagtggcacctcccatggaatttcccatcaaaacaatccttatgccattgcctgccttcttaatcatccagtcaatccatttaagcgcatcatagcggtccttgcagccgaagcctatgaatttaccctcgctttgtccatgcgccctcgcatctacaagcagcatgctatagcccttctttaaatagtaattggatatgctgctgtaatcagacatagcttcacttgtgtagccgtggaagcatatgacggctttatccggattacctccatctatccccggaaaatatgtggcatgcagtcttaatccatcatcagacttaatccacacatcctcatgagtctgtgctctcatccactctccgcgcggcttcataaagctgtaataactctcccagtcaacccccgacatcttcatcgtgcgctccttcttggcattgtagcgcatcatggttctcctgtagaaataagcactgccgcctgcctctgctgcagcaatacagcctaaaacacctgcaattattccccacttcatcctcatcacctacgccttcttactgtctataatctgcttcaggcgaagtgccttatcaatatttccctccaccttgagcctgcctgttgtaaatgcaagaatcggatcaagccttccttctgccagcttaaaaagagtctctgcgctgcatataaaaatcgcatccctgtcaaaatactcatacggctccactgccagcacaccgtcctttacctcggcatagaaaattccctctgcctctcctgttatattaaactgaaaagcaagatgctcgcttatatcgctcacatcagactccataaacagtccctttacctttgaaaacatatctgcataagtcatatcaattctccttttcgaccaccggtcaacttgttacttcattacagtatcactttttcgaccggcggtcaatataaatgttttcgttttcaaactattctgttattttttcataaactatccaaacatatagtatcattatcgttactgtcggtaaaatctcatggaagaatcacatggattgtgataatatatattaaaatgaacgtaactaataaaagaggagccactatgccacattccacaagaccaaattcggaaaaatacgagaagatacttgaagcgctaagaacccttttagaaacaaaaaaaatatcccagatatctgtcagcgaaatcgcccagacagccgggataggcaagggtagcatatattattatttttcatcaaaggaagctatctttgatgcacttatggcaaaaagctacgaagagccgcttgccaccgcaaaggagcttgcaaagcgcaccgatatatctccgtttgtgcgcatggcgatgatatttcaggcgtgtcgcaactcctctgccgcctttttaaaaatccagtccgatgccggaaacggtgtgcaggagaatgcatttttgcacaacaaatacatcaattacctgattaccgagctaaagccggtgaccggtgaaatcataaggcagggagcagctgagggacttatcgtgtgccaacagcctgatgcgcttgcagagattgtgcttcttgtgctcgtcgtaaagcttgacaatacactgattccgtccacaaaagaagagaccgaacagactatctcagagctcatctcgctgcttgagaagggcactgacaatcctgaagggtctctaaatttcctgcgtgtctaaggacactatttatgcttttttctaaaaaaatattggactattgctgccggaatgattcctcccgctaaaatcattccttttgaaagcgccggtgttttacgtacaacgtgaggtgacctttccttactgtatcctacatatataggcttttcctctttgtctgtgtagtctgcctttatatatccgatagcattatccctatccggtacatataccctgattatattatcacgcatatcaccattaaaagctttatatgctgccactatctcataatctgagtgatgcggcagatactcaaaaaaatactgtctattatcaacacaccataacaaaagccatattacaaataccataataagtgctctcatgtcttctttttcgtttgaattttccataattaaacatgcctcgattttaattgtatatatacgtgttacactaactccggcactctgtagcctgcctcactcattgatttctcaaactcatccactgacattccaagcttctcagctcccctgttcaccgaatagtccccatcctgaaccgataagaatatttctgtacgacgtccggtctgaatgccagtctcaattccagtctcaatgccagtcttaattccagccttcataccttctcttctttgttcctcaccatactcttttgcatactcttttgcatattcttttgcatattccattgcgtactttcttacagcttcactcatagcaccacgtccttccttttctttgtaataagccaccgcttttgacaatgtctcactttttatcagctccggcctgcactgatgaaaatctctcatcatccgacctatatcatcattaccttcataccttccatttacatagataatatgcgaaccatctccaaaggcttcacccgtttcatcaacacgcctttgaatgtgataaaatggcagtccttttctgaacttatcgtgatcataaataaaaatcacgtatgaatccttaatctccttaaactcctgtccttcctccagcatcctcgcatccatcatactgctgtgatatctggctcttttgacatgcgatccctcagcattaatctgcacctcgatatcaatatgtctgccatcgacatctattgcatgcacatccaaggtaatacatctcccaccaatcactggattttttaattcatcctgcccccggacgtctataaccttaatatcacgctccattattacgcgaagcagtaactccgttgtctcgatattctgcccgaatacaagactcatcagattgtcatcaaacagcgtcattttgtcaatcaatccgttgatgattacatcgttctggccataattactgccaaaaacctcttttgtctctcccgacattattctcctcctgtttagttgtgtaagcaagaagaatagaatatcgcatgatacaaaatttcttgtcaatataaagcatcaacaaccccagtcagcttcattcacataatgtttctcaatcgacatatccattttccctgctattgataggtaacttaaagcattgaaaatttccatgtctttgtcgaaaaatactaagtggttctaccctcttcaaagtgatacgcaccgatgaaaatgtgtactgtggtgtcgctcaacagaaatataatgctttggcttgattgtagcattaaaaccgcaaaagggcaataaaaatatcaggcaaattcctattatcctattataaaagagagacagccgcgaaaccgcaaaaacagccgggcacatctctcacatatgtctgactgttttttatcgcttactattcagttttattgtagctgtccgctaaattctcctatagtggtacgcaaagtatatattgccggcgattgcggtgagcgtccacgaaatgacgtatatgagatataaggactgcagtgtcttaaaatacgcaaacaccgtgagcagccatataatcctgaatacgacagagcccataaccactatgatggtaggtgctacactttttccgatgcccctggcggcggctgtggcattgtccatgaatgctgatacacagtagacgaattccatcacaccaattctgatctgtccatagtgtatcacggcatcatcactcgtaaagagcaaaaggaacggtctttggaatataaacaatgccactccaagcaccagtcccatcagaaacgagtatgccagggtgatgaaaaatgtgctaagcaccctttcctttttcctcgcgcccagattctgcgctatgaagctggtacatgcggtgtaaaatgctgccatcatgtcatagatgagcgaatccgcattggtggcggctgaattgccctccactaccacatggctgaaggaattgatggatgtctggatacatatattggctatggcaaagagcgagtactgtatcgcagccggcactccaatccgaagcactgctgcagctgcatccctgtcaatcgctatatccttcatgtgcaggccgtagctgccgtatgtcttcatgagaaacctgatgatgagagccgctgagatgtactgtgctatgatgcttgcgatggctactcctatcactccgagtctgcacactattacaaaaaacaggttgagcactatattgataattcccgagatactcaggtatataagaggcctctttgtatctcccactgcgctcagcacaccgttaccgaaattataaagcgcaagcgccggcgaaccgcacagatatatcatcagatatgctgtagcaccgtctataagctcaggctttgtattcatcacttcaagcagtggctttgaaaaaaccagacctgccactaacagtaaaagtcccgctataaagcacagaatgaccgatgtgtggacagtcttatgcagcctccgatagtcctctgctcccatgtgcagtgccgtgacagcattgacaccgcctcccatgccaagcagtatgcctgttgtgagtgtgatgatgatcgtcgtggaaccgaccgagccgagtgctcttgcacctgcaaattttcccaccactgccacatccgtcatattgaaaaatacctgaagcaggtttgagaacatgagcggtatggagtaaatcagtatcttccttgcgagtggtccgttcaccatatccagttctttggtctgtgttgctcttgacttcattttttcctcttgtaaatctataattatatattaacactgccatgtgaacagtactctaattatagatacgtttcgttcttttttcaagactgttgtttacgctttacaaaaaagattatataataaagtcaaaatgacttaaggggtaaaaaatgtttctctgctgcgtcacgatatgaggcactttctgaataatatagctgccttcatcgaaaacaatgaaaacgacaaggccttagctcataaacgatatgcccgttgcaacagaaagagggcatggacttggtacaaaaagcatcagacagactgctgagagactgggcggcaaatgccagtacagtgtatctgatactatgtttatcgtgagagtaataatctaatctgattcatacaaaatagccggtgcttaacacaccggctattttaattcatatacaataaataattcaaatcataatttagaaatctgtgaggtttgcagctctcttctcaaggaatgctcccattccctctttcttgtcgtttgtatcatttacaacaccaaagaggtttgcttccatctcaacagcgttcttgatatccatatcatatccgttgttgatagcagcctttgcaactgcgattgcgtagcttcccttagagatgatctttgcagccatagccttagctgttggcataagctcctcttttgctactaccttattaacgagaccgatgcggtatgcttctgcagcgtctacattgtcgcatgtgaagatcatttccttagcacgtcccattcctactaaacgagcaagtctctgtgtaccgccaaagccagggatgattccaagtcctgtctcaggctgtccgaaaattgcgttctcagaagcgattctgatatcacatgccatagaaatctcgcatcctccaccgagtgcgaatccattgacagctgcgattgttacctgacgcatattcatgagcttgaagaatggctctgaagccttgattccgaatgctcttgcctgtggtgctgtgaaattaaccatctctgagatgtctgctcctgctacgaatgacttgaactcgttgcccttcttgtcaggaccacctgtaaggataagcaccttaacatcgtctcttgcctctatctctgttaatgctacatttaactcatcaagagtctcactgtttaatgcattaagagcagccggtcttgaaattgcaagtactgcaatctgatctgctacgtcaagtgttaaatttttgaactcgctcattgtataaatcctccttaaaaaacctatgtataaccgacatttctgtcgtaatttataaaaaaatagtaacactttgacaaatttttgtcaatgtctgaatgacctttttcaataatatttaccgtttaatttaatatacaaaatttaaggagacagtctgcttaatgcaaactgcctcccgccttagaaataatataatcaaattatttaattaaattaaatcaaaactcaaattacataagtccatgtgtcctgttgtaagcattgcagatcatatttgagttcttgataaggatgtgcatagcgatgaatggtccgattccacagataagtgtaccaaatatgcaccacatcaaaacagtggttccattctcctgaatgccaagtccgtatctgcctgcattatttgccagtctgttgcccagcttatagtaccagtaccatgcataaataccgcatgtaatcattgaaagcaggataaatgctacgagacctgatgtattctcgccatctccatcacatgctacattgacatcatgagccatcttgtagatgaaataatatccataaataccacatgtaataatagacaggatgatgtatgaggcaagacctctgtcatcctttaacctctctcccctgtatggtggaggagtctgaccaccattgttctggtagcctgtattgtactgtcctgctccgttattctggtagcctgcgttgtactgtccggctccgttattctggtagcctgcgttgtactgtcctgctccgttattctggtagcctgcgttgtactgtccggctccgttgttctggtagcttccattgtactgtccacctgcattctgctggtttgcactgtttcctgtgaaggactgctttacctcatcaaatgcacttccaagctcctgctctgctgcattgaaggcctctcctgctttgttgacaaaatcctgtgccttggaaacaggtgctccacagtatggacagaatttcgttgaatcaggaatttcttttccacatttctcgcaaaacatcttctttctcctttttatttgctatttattatacggatgatacgaaacaggatgttgttttgcggctcaaagaccacgacatcatcgcctgaccatatcaatctgcatatataaactatagcaaacataatgatgattgtaaatataattattttataaattttaatatttattttagatttacacaaaagcactattaccgcaataggcacaagccaaaaaagcggatggtatgcaaacgcctttgctatatcaaggtgtaaaaatgccatccatgccctcgacatgccacagcctgcacatgatattccggtgatgaacttaatggggcatgtgatgcctatcgactccatagctgtgtaaagtaccactacggctgtaacagcacatatgatctcttttctttcattttttcttttattatttcttttattgtccatacaaatgttatctcaaaaagtatgcactgtaaggtggcagctcaaggccatcgtttaatgtaacctgctcacctgtaatcaggtctgttgcatcaccctttcccatatcaaagcccgcgaaaaacggctggtctgcggcattgatgcacacaaacaccttttcgtcatcacattcacgaccgaaaacgcactgtccgtttgtgagcacaaccgaatagaaattaccgtagcagagtgcctttgactgcttctttgcctctgcgagctttgaaatccattcagtcagctcattgtactgtggcgcttcaaagcatgccctcagagccgggtcaccgtcttctttttttgccttctctccccactcactgccatagtacacacaagggatgcccggcataccaaatgcaattgcatagattagtggcagatgcttttcattggtcagtatgcttgccactcttgtcacatcatgattgtccacaaatgacaggaggtgcttacccttgtagagagtccactgctccggtccgaactgtctgagaagcgaatgatttatctcaaacatattcatggaattaaagctcgagtacagacccttatagcactcatagttcgttaccgagtgaagcatcgcatcattcataatctggttgtagtcaccatgcagtgtctctcccaccaggaagaaatccggctttagtgagtcgcagaactcccttagtcttctgaggaaatcatggtcgaggcagtatgccacatcaagtctcagcccgtctatatcaaactcgtctacccagccctttatcgctgaaaagatatgctggattacatcctcatttctcagattaagcttgaccagatcatagtttccttcccagccctcgtaccacaatccatcattatagtttgaattgccatcgaacgctatacggtcaaaccagtttacatatggtgagctttctctgtttttaagcacatcctgaaatgcccagaagcctcttcccacatgattgaacacaccatccagcactacctttatgccgtccttgtgcagattgtcacaaacctgtgcgaagtcctcgtttgtgccaagccttgtgtctatttttgtataatcccttgtattatatccgtgtgtatcagattcaaacaccggtgaaaaatagattgcatctgccccaagctttttgatatgaggtatccagtcattcactttcaaaattctgtgctccaaaacaccatcattctcaaatggtgctccacagaagcctaacggataaatctgataaaatacactttcatatgcccacattattttgccctccttgatagttgtgtagtggttttgtacctgttatctgttatctattatacacaattatgtacttatatgctacatttttttgttactttttacctacattaagtattttgttaccttgtataattaaatttctaatagaaattcctgtagataacacatgcaataaccacatggataaagaaaataagcggcatcccctttacaaaataccaatgctttgtcttgtgcctgaaggcatacatcccagcccaggtaccggcgcttccgcccagcaggctgagcccaaataatgtcttctccgggatgcgccatgcgtgtgccttggccttacacttgtcaattcccatcgcagcaaagcctgctatattcataagaagcagataaatcagaaaaattttcatataaataatgctccattctattactccgcacataaatttataaatatataaacatatctgcatatattaataagtccacaaaaaacaatagcccagcctttaaaggccgggccataaattaattattaattcttagcttttttagaaaccttagccggtgcagccgcctgctttttaatggcgctcttgcccagataaagcttcatcacataccacagctctgtagcgatgcagattgaagaatatgttccgcaaagcacacctaccatgagtggtaatgagaactctctgattgatgtatgaccaaagataaagagtaacaataccataacaaatgtagtaagcgaagtattgatgcttcgtgaaagtgtctgtgtaagggactcgtttgctatatcagcaagctcatctgctgagtacttcttgataccgtgaaggttctcacggatacggtcaaagataacgattgtatcgttgactgagtaacctacgattgtaagtatacatgcaataaacgtactgccgactgagattctgataagtgcatatgctgtgactacaacaagcacatcatgtaccagcgcaaggatagcacttgaagcaaatctgatgtccttgaatctgaaccagatatataacagcatgaaaatacatgaaataataactgcctttacagcgtttgttctcatctcaccactgattgttgagctgatactctgagtctctatagttgatgcatcaacattaaaatccttctcaagaagagctgcgagatcctgtctctcatcgagtgaaagtgtacgtgtctttaatgtgacatcatggctgccctgaactgtagtaacctgcactgcactattgccaaggagctttgatactgaaggcacgatgtccttctcaacctctgcggctgtataatccttgccaaagtctgcagtggttgatgtaccacctacaaactcaagactgtagtttaatgcattgccgcttgtagcaccgaaataaatcatgccgccaatacctgcaagtataactacacctgagataacaaagtatttaactctgttctgtacaaatctgataacctttctcttctttgccttgccgtagaacttctcagctctgacaccgacaccgtaaaatgctcttgtaaggtattttgcaataaaaagagctgtaaacagtgacagaataattgaaatcataagtgtgtatgcaaagccctttactgtacctgaaccgagcaccataagcacaagtgctgcgataaaggttgtaacctgtccatcgaggatggctgaaagagccttcttgtagccctcatttactgcagcaagcactgatttgccacctgcgatttcctcacggatacgggcaaatacgataacgtttgcatctactgccataccgataccaaggatgatacccgcgatacccggcagtgtaagtgtaatctcaaaccagtaaataaacagtactgtaagcattgagtagagtgcaagtccgatagatgcaaccacaccgagtataccatagagcacaatcatgaatatcatgattaagataattccgataattgcagcctttactgcatttgtgagcgctgttccaccgagctgtgcgccaacaacatttgactctaactcctcgagctggaggttgatggctccgacacggataaatgttgcaaggcttgttgcctcgtcgtaatccttcattccgttgattacacagttaccatctgagataacggcgcttactgtaggaacgctgatgaaatgatcatcatagtatataccgattgactgtcctgcatcctttgccttctttgtggcatctgcccatgtgtcaatagccttatccttgagctttaatgaaacaacaggctccttggttgatgtagatgatgactggtcatactgggcgcttgcatcctttacatcgttaccatcgaggatgactgagccattggcctttaaggtgtcaatatcatagttgagcttgtagccgccctgggccgatgtgtcctgtgtatagttggcatttccgtcactgtcatactgggcgatgaagtacagtgatcccggacttccaagatcctcgagtaccttgttagggtcgtcaacacccggaatctctacagtgatacggtcatccccgctcttgtatacagagtactctgttgtgtagctctctgcacgctcctcgagctttgcgatagtatcatttacatccttgtctgaaggattcttgtccttgatatggtaggtgattgaaacaccacctgagaggtcgagaccaagcttgatattctgataatccttatccttggtgctctcaccattagcagttgcctcctgcttttgctttgtgtcggtgattactgcagtggaataccagcccagcaagccgatacaaatgactgccacaaggataatcacccaactctttccttttttcattttcttataccttcctgtcattttgctaccatccatataggtatacagatggcaaatatattcgcacacgggtcacaaataccgctatccgtttcccgtgacaaattcaaattattgtgcatcatctgccatatcagcctctgctgccttaatcatgatagcgcactctatacgcttcttctgcagctcgcagcctaaatcataggcatcagtgattgtgccgtggaagttgtatgagttggcggcacagccaccgctgcaatagaatctggcaaaacagttgcgacatttttccttggcataaacattacagcacttaaactcatcctggatgtcagtggccttgatgccatcccagacattacccataaggaagtcctcattgcccacaaactggtggcatggatataaatctccccatggagtcactgccaggtactcagttcctgagccacaaccggaaagacgcttatatacacaaggtcctccctctaaatctatcataaaatggaagaaattgaagccgtttcctgccttgtttctctttaccatctctgctgcaagtctgtcgtactcatcaaagagcacaggtaaatcagattccttaagtgcatactcatctgtaggctgtgccaccacaggctcaaccgaaatctgtttgaagcctaaatcagccagatgaagcacatcctttgaaaaatcagtattgaaatgtgtgtatgtacctctcacatagtacttgtcctgatgtctgctctctgcaaacttctggaatttcggaacaataaggtcataactgccggcaccctttctgaaaggtctcatacggtcatgaacctccttgcgtccgtctatactaagaactacattatccatctctttgttggcgaactccataatctcgtcatttaagagcacaccgtttgtggtgagtgtgaacctgaaatgcttgtcatgaagcttctcctgctctcttccatatgccacaagctgcttcaccacatcccagttcatgagaggctctcctccaaagaagtctacctctaagtttcttctgctgcctgaattggcaatcaggaaatcaagtgcctgttttcctgtctcgtagctcatgagagctcgtctgccgtgatactcgccctcctctgcaaaacaatatctgcaggcaaggttgcagtcgtgcgcaatgtgaaggcaaagtgcctttacaactgtctggcgcttcttgaaatctatgatacgctctttgtatgtatcttctgtgaagagctcttcattatccttaagctcatttacttcctgtattgcttcttctatctccgtctgtggatacctgtccacaagcttttcaataatctccttagctgagttgtcctcaaacagctcaataacgtcatatgtgacatcatccaccacatggattgcgccactgttgacatctaagacaatattatagccgttgttcttgtactgatgaaccactacaatattcctctctttctatacacattttaaaattacactgcgaaaagagtgtgcacctatcagcgcacactctttaaatccgcttcacctatgactatttgtactgctcacaagtctggtttccaactgtacaagatgtcttgcaagctgactggcatgatgtctggcactcgccacatccgccctttttaactgtgttctgtaattttcttgtatttaatgtctttacgtgtttcatttttatctccttttcatttaacgatgtctcattgacacatcatatttgctttcaacattatatcacagcattatcaatatgaaaagtccttttttagcgaaaaacaagcgctgaaaacattaccagaaggagtattatcaaaagctcgaatatattttttgattcacctatatctatgaccactgttgctatcacatacgttatccagtatgctacgaccgtcaccctgataaaacgtctgcggtgaaagcagcatttgagcaaaaatccgcacacaagccccaccactatattgaccgccatggcaagtgcaaactttatccactccgccatgtcgacaaagcactgtactatagaaagtatgataaggcacaaaagcgccgtaagatgcataatacatattgttatcacaggacctttgatttttctccacataaaaacgccctccacacatcatatatatgtgcaaagggcggtaattattcatatatgaaattcattcgtgattacagctcacagttattaactgttctagggaatgggataacgtcacggatattgcccatgccggtaagatacattacgcatctctcaaagcccagtccaaagcctgcgtgtcttgcagagccgtattttcttaagtcaaggtagaacttgtagtcatcctctgaaagtccaagctcatttattctggcaagaagcttatcgtagtcatcctctctctggcttccaccgatgatttctccgattcccggtacaagacagtcaactgctgcaacggtctttccgtcgtcattcagcttcatgtagaaggcctttatctccttcggataatctgtgacaaatacagggcgcttgtaaatctgctctgtaaggtatctctcatgctctgtctgtaaatcacagccccatgataccttgtaatcaaacttgtcattgtgctttgaaaggatgtcgatagcctctgtgtatgtcacacgggcaaaatcattttcaacaacatttcttaatctgtcaagcagtcccttgtccacgaaattgttgaaaaatgccatctcctcaggtgcattttcaagcacatagttgataacatacttgagcatgctctctgcaagcatcatatcatcctcaaggtctgcaaaagcaatctcaggctcaatcatccagaactctgccgcatgacgtgtggtgtttgaattctccgcacggaaggtaggtccgaaggtgtagatattcttgaatgccatagcatatgtctcgccgtttaactgtcctgaaacagtaaggttggtaggcttattaaagaaatcctttgagaaatccacctttccatcctctgtcatagggagattgttcaaatcaagtgtggtcacctggaacatctctcctgcaccctcacagtcacttcctgtgataagcggtgtgtgcacatacacaaaatccctctcctgaaagaatttgtgaatagcatatgcgcagagtgagcgcactctgaaaactgcctcaaaagtattggtacgaggtcttaagtgtgagattgtacgaagatactcaaatgtatgtctcttcttctgcagaggataatccggtgtggatgcaccctcaacagtcacctctgcggcctgaatctcaaatggctgctttgcatccggagtgagcacaagtgtaccccttacgataattgcagctccgacattgatcttgccaacctcatcatagttgtctaagccatttccgtatacaatctggattggctcaaaaaatgtaccgtcgtttaccacgataaatccaaagttctttgaattacgattgcttctgacccatcctccgatagtcacctctttgtcagcgaatttgtccttgttgcggaaaatctcgcgtatgtttgtaagttccattatctaatcctccatttaagctgcctgcgcatcaccacagacagcatatttatcgttattattcggcatccgcgctgccacttgaagtatccggcgctgcactgccatcctcaaatgtcacatttgctttctctgtgactgtatcaatagccttgtttacaaggtactggttcttaaggtatgtctttccctcatccttgtgtccgcttccaaaatacttgtatacctcagaagccttgctgaactgaccattgctggctgatacgatgtaatccacatagctgttgaaggcatcatcatccatcttgatattttccttctcagctataagcccaaagatgaactctgtctttatctggtctgtcagattttccttccacttctctgttgcctgatccactgtcatgttgtagttggactttaaatatttcttaagtgtctgtccatccttgacattttctttggtaaatgaagcaatatactcattgagtctggcctgtaaatactcatcaggaatctcgactgtgctgttttcaatcatgtagctctttatcttgtccacctcagcgctgtagagcttctgcttcaaatctttctcaatctgtgtggtaagctgggcattagttgtcactccggcctttccaaacactgtgttgacctgctcgtctgtcatatcagcaagtgcaacaggatctgctgagtaaatgccctttactgtatactcaaatgtaactgtctgtccgtttaagtcgtcattgccataatcctcagggaaagtcacatcacccttaaccttgtcacccaccttggctccgattaaaggctttgtaaatccatcgataaatgatgaaccgccgacctggctgttatttgtcacatcaagcatcacatctgtagctgagccaccatcaaatgctttgccatccttatatcctgtataatcaaccttgacataatcgccatctgcaactgtatcacgatctgtaacctgcttgtacgcatctgcaccatatgactgaagcacattggtcagatatgtctgctttgctgtatcgtttatctcataatcgtttgagactgtaattgcaacacctgaatagtctgcaagctttgtaacctgctttgcgtagtctatgtcaaactgtccgcttcgcatcgtctcgctgccggcctcggtgcctgcctctgttgcgctctttgagccaccctttttgctcttgccgcttatcacagcaacaagcgcaataattaccacgataagtgcaatcacaatcactgctatgactgccttcttacctgtattcttcttctcactcattggaatcctcctgaaatctgtaagtcatgttatttatatgtataatgccctgctacggcaaaaacgcatccgcaaaacactatacctatctacaatatcacatatcaggttaaattacaacgagtgaaaatttctttatctttgcaaacaccggaggagtatgcatcctaagccctactgtcaccctggcattcttttgcagccttaccggcttaagcagatgtgtcacaaacctgatatcatccgggaaaatgtcgcttgtatatgtatgaacgccgctttcatcctccacatccataaacagctcgacctcgacacctgttgtattggttcctctatagtcaaccgctgctatatactcaccggtatattcaatatccaccgtctggcttatcgaatagtcaaaattggcatctgaagagataaacactccatccttacccagtgtatactgtccttcttcgaggcttgtctcaatctgccaattattaaatccatccttaaattcaggatttgagattagatttccatgaatcataagaagcttcatgaaatcctccacctccggtgtttcttcatactcataaagtgattcaatatacttatcaagctctttaatcggcggatttttcggatcaaattccctgattgcatcccagcccggcaaagccctgccatgctcgtcaaacatacccatattctcaaaccaggttcccatgcctttaccaggcacaccgacaggctcccagtagtatacacctgtctttccggtatcctttgacacctctgctgctatctgcatgattatttcaagagacttcttctgctctgcgctgcctgcatcaaggcctgcagtctccatgagttccttcgagatatgatctcctttgcaatgcctccacggatgggctgtctccacaatataaaccggcagattatataattttatgagcctgctcatagtatccttcaaatccatgaaggtaccatgccagaacgaataaaaggaaaggccaatcgcgtcaatcggcagcatgcccgcattaaacatagaatcaaaccaaggcataatacagttatatctgcctccctgatccagatgaatcatgacctttgtctccgggagcagctccctgacagctctgattccctcatttacaagcgcagccagctgcctgtactgtggcactgcaccatccggaaacagcataccactccttatttcattgccaatctgaaccatatccggcgcacaatccatgatttttaatctgtatagcacatcatatgtgtacttgtgcactgcctccttcagctcatcaaagcttaaattcttccacgcatcaggcttattctgctgtcccggatctgcccagtaatctgaataatgaaaatccagcagaaaatgcattttgtattttttaatgacatgagccatctcgagaacatatgtaagactgcaataccccttagactccggcaccttatcaggctcattccatatgcgcagacggactgaatttacattattcagctttaaaaaatcaaataccctgcacacatgaccttccctatccattatttgtatattattgtcaaccatcataggaacggatgaaatatccactccctttaagaaattgctatcctttttctgcttgcgctgctgcttaagctgatacatctttgtgtcagcacttacgagataatcgtcaaagctcttaccactgcccggcttcgtatatatgatgccgtgactgataaacaggctgtgctgctccatgatatcatacacgcgctttatatacttctcagcagtgtcatgtctgtccccagggataaacacgataaattcatctccaccgaatctatataccatacttccctcaggcttttgctcatcaagcaccctcgccacagtctttaaaagctcgtcaccgtactggtgtccgtatgtatcatttatgtccttgaaatcatccacatcaagaaatactatggtgcagccgacattttgagcttcaagctcagcaaacataggaatgaccatctcattgcatgccacacgattgtataggcctgtgagcgcatcatggttgtagagattcttaagctcattatttgtattctcaagtaccttttgcttaaaaagattctcaagcctcttgagcagggcagactgtatatcaaactgctcaggatggtcgtacaaaaactctggattcctgagtattacatagcccactatctcgtcccggaaatgcagcgagcaatacatatagcaggtgtttttatctacactctgcatgtactgcataaggtcatttacactcttaaactcaagctttccattgtccttgtcatccgcatagagtacaacctcgtcgtcaatatcatagccatgcttcctaaagtgtgcattgttccttgcagctgccagatcagaaacaccgaccacatacactccgtcacacttcatgctctgtatatagtcagagtatctctcaaacaaatcatagtattcattgcactcctcgagctctttctggaggatcattactgcatcctcctcctgctctcttgcaacggagcctttgataatattctttatgtaattacgataatccactctgccggtattagggcatccgcagctctcagccgggataaactcagaatcaaggtatttatcagaagcatcgcccgtgccattccaaagcgccttaaatatctcaagagcatttctgcctatattgcccctgttgttatccactgttgtaatctgtgggttaaaatacgcagccttatccagattgtcaaagcctgtgaccttaaaatcctgtggtaccttgtatccaagaacctctgctgtcgcacacagtcctgctgctatattgtcatttgcacataaaaagacatccggtaacggctttttgctctcgtgccaatcactcatatacctgacacctgtctgataatcaaaatcaccaaacatgtacatatcagctgtaagtggtatgccataatcacttaaagcctccttgaaggcctcgaaacgcattctgttctcataatgatacggcggaccacctgcaaacacaaagcttttgcagccatgcgcatagtacatatgatccattaccttgcgaaacagcctcttattatcgttgcctacatagtaaaacccatcaaccttatacccgatactcactaccggcacatttaccgactgaagctttctgaccatatactgtatctcatccaggttggtcgtattggtgcagtcaaataccactccgtcgaaactgtttaaatcaggcaaatcgttcagcgcatactcgcctttgttaaactttgaatcctgactccaggttccgttggtgttgtaaaaatacaggcacacatccagtcccagctctttagagcctcccatgataccctcaacccacgaatatattacatatcttctccagccatcagccaaaagagcaattttcttcattaataaatacccctttgcgtcttctaaagacttttccaaaatatagttctattatactacggttttacctattcttgcaataaagattgattttttttagcatatttgatagaattaatttaaataagcaaatttttaggagggatacgttttgaatccagcattaatcgtacttattgttatcgcagtagtgcttgtggtagcatttatagtattaacaatcctcggtaaaaaagcacaaaaaagaaaggaagagcaggacgaacagatagctgctgcatcacagacagtcaatatgctaatcattgacaaaaagcgtatgaagctaaaggatgccggtctcccacagcagattattgagcagacaccaaagcttatgcgccgctcaaagcttcctgtagtcaaggccaaggtcggaccaagagtcatgtctcttatcgcagacgagcagatctttgatgagattcctttaaagaaagaggtcaaggcttctgtcagcggtatctacatcacagctgtccgcggtatcagaggacctcttgagaagcctaagaagaaaaaaggcttccgtgcaagaatggcagaaaactacagcaaggccaacgaacagctcaaggctgaggaggctgcaaaggctgaaagaaaagctgctaaagaggcagccaaaaaggctaagcagaaataatatcatgatttaattttcatgtacataaacagagcatgtgggatggctttcatcctcacatgctctgttttttatatgctttatccatatatgctttatatattttttaccccataggcttggcagacttttatgcaattttgactgctgcgccttttttcttcacagctatattgatgtgacagtcgcctacaaattcatagttgacatcaagtgcatactttacctctgcccttatctcgtcctcagtctcctttacctctatgcttgtggcatcaatacctatctggatacttccaaacggtgtataataatatgtcaggtttttctttcccttctcaaatatcatatgtacactcataggtcccttgcgggtgaactcaagataattgtcattgaatttaagcatatttttgagtgtctgggtctcaccctccattatctcctcaaaaagcacatagtgtttgttgtttcttatataatactctcccggggcaatcacctctaccgcatccgactgctggtccggtgcgagctgcaggccctttaatgatactactacatcctttgtcatttttttctccttatcctctagcatatctaaattaattcacgctttaataatttgtcatcacatattttcttttaatatattttttcagcatgaatatactaactgttttatctgaaaatatcaaggatttttagttttatttcatattttccactgtcaaatatgctctcatactcgtccggagtgagtacctccttaagattttcctttgcttcatcctccaccacctcgtacacactgcccctaaagcacatgtttggatacagcacgcaccaccagttatgaccggctccatcgcccagtgttatttcaagcgcctcgtaatttccctcaggaaatgtatagtccccatacgtcttttccgggaaatcggtgtgtgtaagctctgccgatgcgccatatgtaaaaccgtttgctgcaagcgtctcctttgataccgctattatttcgtccatatggtcatttacggtggctctggtttcttcgatattttcgcactccagcagatatggctctatgtaagcccctactgcatcgcgcacctgctttttcacattctggtctgcttcgctgtcgctgtttgccagcacgtgaaaacgcaggattttgccggcgatggatttttgcatgtcggctgtacacgctatactattggtgtttgcggcaggtgtatgattttttgaagctatcgctgccgtaatggatattattgctatggttgttattattattttctttctcatgtaaacaagtattgccttatttgacgagcttattcatcttttttgaaaattttaccggatttcatgaatttcattcgtatagtcatccagcaaggtaccaagtgtaattatcggttcaccatcctcatgattctccttatttattttctgctcataataatcacccatgttatcaaagatatcgtttatatcatctgctatgcacacatatgtgtttctcggaaattttttggatgtcttgcagtattccatgaagcttgcataagctgctttatcatttctaagcgtttttcctattaatatcaccttcagatgattggtatcggctttttgtgacagccgctcctcgaagctgtccacggctgttttgatatcatctgcatattcgggctcataggatttgtccatgttataataaaactctatatatccgctactttcatttgccaaatcatctctgtggctaacatattctttgtaatcagttacatctttacctgttacttctttatcggttatttcgtcagtatctacagctacaacatccaccgcagcaagtgtcggaaagcaacgctcctcaagctccactgcactacagccggtaagcatgagacctatcgtcagcactactatgaccggtatcgctatgcacattaaaaatccaagatattttttcacgatttcatctccactttcaagaatatatgctaaggtcactgtgactgctatgacaaaaatgatgcaccagcttctcatagtgctcttttccttgtcatgacttttctgtctgtcagagccaaattgcttattgctacaggaatgccggtttttattaaatgtaaatataatttctctcgtattttcagcaaaattctcacatcttaaaaccgcataataaaggctcataatgagcactgaaaacagcgtgaaaaaccacaccgacagcatcagtgcatctgccctcttaaagaagcttccctttatctgcacatcactcatcagtacgacagccggaaactcgatttctgacaatgaatattttccgaagctcccaagcaatactgcatacaataaaaaaagaatgcctgcatatgtgagtattgctttactcacactccatcgtatctgtgaggcagtgcgctcccttacaaacagtatattgaacacggaaatggatgctgcaaacacatagtatgcgcccgcaaatatatccgctatgccaaagtccacaccgactctgtccttaatcatcagatagtctaatctcacatccgatagcgcaaacaaaagcatagcagcaagcggtatcagcacaaagaaaaatactacctcgtataccctggcacggcactccactccgccacttagcgcataagcgcacactgccattatcacaagaagtacaactgtaaatgactcatccggtataaggctgtcacgtatcagctttacaaatatccatgcaagaaatgcggcctgtgacagttcgtatatcacaataattaaatcataaattaacatttttgcatgtgttgttttaccaaagcttctgtcatatatacttttcttctgttctcgtacctcgcttactatccacataaatagccatgccatgaaaacaccaagtgcgattgagataaaaccatactttccaagcttcgccagattgtttggaagcaccagtgtgccgactccaagcagattaaagacgtatagcctgtatagctggcgtggcgatatgctttcattttgcgcaaatgtgtagcttgtgctcatatttttagtcatccttatttcctttcagctttctgcactccttttcccttgcaaatacaggccgccgccatagtctgcgaagcggaaatcgtatgatactgtccttttcatcctcgccgcctgtcagctcgctgcccacgaatggcatcatgtatggataaccacagcttttgagctttgcaagatgcaaaagtatcaccatcagacttattaaaaatccaaagtatccaagccatgccgacataattattacagcgaatttgagtatcctaaatgaaaatgcaaactcctcactcggtatggcaaacgagcagagtgcggtgaatgcaaccaggatgaccactatagggctcactaaatttgcatccactgctgcctgtccaattatgaggcctccgactatgcctatcgtgtttcccattgctccgggaagtcttatgccggcttcgcgaagcagctcaaaggacagctccatcatgagcacctctatgagctgcggaaacgggcagccgagtctggcttcataaaatgccagtatgagaggtgtcggcagtatctgtgtatgaaaatttgtgaccgccagataaagccccggcaatgtaaatgacatgaaggctgccacgtaccttatcaatctggcaaagcttgccgctatcgttctgttatagtaatcatctgcggtttttaaaaaattgttcatggtggttggcagtattatcgctatcggtgaattatcgcacagcaccaccactcgcccttctagaagcgcatttactgccacatccggccgctttgtggtctgaagctgtggaaacggtgaataccattttgcctcagcaaactgttcaagaactcccgaatcccccacatggtctatcacatagctgtccagattcctttccacatcctctacaagtcccggttttacgaggtctctcacatacaatatgtccacattgctgtgtccgcgaagcccctttttcacctctttacactttaagcgagtgctccttaacctgcgcctgataagtgcagtatttatctttatggaatcagcaaagccctcatttgagcctcttatgaccttttccgaatcaatctcctgaattgacatggcgggatatcccttgtcgggaagcttgaaggcatccggatagccatccacaaaaaatatcacgtctcctgtcagcatcatctgggctgcctctctaaccgtatgaagatgcgcaaattcggatagagctgcctgatttttgtcaagtacttccttaacctgatcccggtctatcccttcaaggtatgatgtaaatcgtccaaacgcactgttattgataccggagcctgcacatgtcacctcaatatatgcaacaaaacactttatggaagcatcacgccccagatacatctcctgcatcttgatatctgagcagtcagaatatatctgcctgaagctttttatgttctcatctatgtttgtggtcatctttaactctcctatatacccaataaatcccgtaagatttaaaatccctgatatagtatgaccatacaagcccgcaaatatccctgattacttattttttgctattatctaagccactaactaagccactaaaaaaaggccgccgttcacacgtcagtgcaaccggcagcccctggttttgttatattattttgtattttattatctttgtctgctataatcttgttatatttctgttttatttcttctcttcatcctgcttttgtatcacagcctttacagcaaccgcctgattagccacatgcgtatgcatttctgtagtcacaagctccatatttcttgcctcaagcgccctgtagatggcgtcatgctccttcacaagcatcggataattctttgggtccttcaaatactccactctgtagcggtacatctgctcgcggatattgttcatcatagatacaagcttcgcattgtttgttgcctcatagatagcatcgtgaaacttcacatcctcttcagctatctttttcacatctcctgagtccatgctcctcttgaactcgtcctttatggtttttagattcgcaagctgctcatcactgattttcttacaagctattttggctgcaagctcatcgagagcctctctcacctcaagcacatcctccatatccttgagagtcatcttggcaacctctgcgccctttctcggcattgtgactgcaagcccctcctgctcaagcattctgattgcttcacgtataggtgtacggctgactccaagctttgacgcaagctgcagctccataagtctctctcccggcttgagctcgccctttaaaattgcctcacgaagtgtattaaacaccacatcacgcagtggcagatatgcatccatatttaaagttaaattatcagtcatcaaacttctcctatctcttgtattatcattctcacatataagaaaaaagtaactataaagcacccgctgtgctatccggatatcacgttatttgcgattattgtatacagatgtcagatacacctgtctggcaagatgtgagcttctcatggctttgtacgctttctttgcagtatcttcatcgtcaaacagaccaaaaaccgtcggaccactaccgctcatcatggctcctaccgcgccatttgaaagcatatgcttctttatctcatctatcaccggataatttggtatggtcacagtctctaagacatttcccatatgcgctgcgatatcatgcagattcttagcctttatatcatctatcaggcggtctatatccggatgaatagttgtatcatcaagcttcagattctgatacacaaattttgtggataccgagatggacggctttgcaataagcaccggacactttaccattggaggaagagaactaagcgcctctcctatgccctcggccagcgccgtgcctctcataatacagtatggtacatccgcacctatctgcacacctctttccataagctgtctctttgtcagtcccagtgaaaaaagcctgtttacacctataagcatagctgccgcatcagtactgccccccgccatccctgctgcaacaggaatacgcttgtccagcttcactgatacaccgtcagttatagaaaactcatccatcagaagctttgcagccttgtatatgagattgttctcgtttacaggtagaaaagacagattggtctgtatctgtatgcccggctcctttgtccttttgatatcaagcctgtcatacagatgaatggtctgcataatcatacggacctcatgatatccgtcctctctgcgcctcacaacatcgagccccagattaatcttggctaatgcttttaatgaaatatcgttattactacccatattgtattacctctgttttttgtatacaaggattataacacaccctgccaaaaagagcaaatttaaatattctcatttaattgttcattttcattacttttcagattttccacgtattgcacaaaaacactatgttcacatagtacatgtttactagatttaaaaagtaaccctctaacgcaccacaacaaaaagcctcacagcatatcaataatgcttgtggggcttttttaaaaagtttctctaaactcgtatgtacaatttttctatttcttttccaatataaatttgctaatcagctcgttcattgtctccgcctgtgctgaaagctcctcacttgttgctgatgtttcctctgcatttgctgagttggactgtacaacatctgatatctgattaataccggcctctgcctgctccatagcctttgcctgctcctctgcaatctcgctgagtttttgagaagaatctgcaacttccttcataccattgataaccttttcaatagaagtacttacgcgctctgcagcttcattaccctcgttagataccgcaatggcactctctataagctgacgtgtgtcaaccgcagccttggcactctgctctgaaagacttctgatttgtcccgcaacaactgcgaatcctttacctgcctcacctgcacgcgctgcctcgatagctgcattgagtgaaagaaggtttgtctgactggcaatatcctcaatctcagaaatgatattctcaatctgcttagatgtatcattgatgcgtccgataacatcaaccatgccctgcatctctgtatggctgtgatctgcttcctcagcatactcctgtgcaatcctgtatgtatcattgagcttctcagatgttttctcaacaccgcctgtgatatctgcaaatgtagcctgaagctcctcaatggctgctgactgatccatagtaccttctgctatttcctgtgctgcctgagcaaggttgttagaacctgctgtaacaagtgatgatatctcattgatatgtgacataacatcattcatctgtgtcttcatctgacgcattgccatgagaagtccaataaaatctccggtatatttatcttccatgtctgatgaaactgtataatctccttctgccatctttccaagaagcttgtcagagtcagatatgatagtcttaaggtctgctgccatgtttttcgcaacccctaccatatcagcaatttcatcttgtgaatcaactgccgggaatggagcctcaagatcaccctgtgcaaatgtacgtaatctctgttttaactcatcgagtggtttagaaataccaactgcaacttcgtccccgattttcatcgagataaaatatgaactgacaatgataacaataacaataccaaatacggcatatgatactaatgataatctcttgcttaaattatctccatctgttacctttgtatccataagggcaacaagctgctgatatatatcatcatatgcaggtgcaagatctgctactgctctctcctcggcctccttctgtgtctcaggatctgtagcattcctacctaactgtccgatttcatcatcgagactccagtatgagtcgagcttactgtttatatcatcatatatagcctgctcctcatctgtctttatagagctttgcagctctttccagtatttttgaaatgattcctttttagaatcatgtgtatcagacatcttacttaatgtgtcagaagctgtataaccgataagagctcgtgtagcgcttcgtgtctctgagaaggttaccataacctttcctatatctccctgtgaaaatccgtaaaaggttagtgcgctggaatatctcattgatacaagaatcataagaatacccgcgataacccccgatgccgatgctacaaatgtagtcagtctgaagcctttctttaaacgatttttgatgctaagtgctttccactttgacatgtctaatttcatgatatttcctccacatgaataatgatacttatatactattcttctattatacacctctcaaaaaattatacaagcactaaaaaggtgactgcacgctgcgtgcagcccccttttcataattcataaatcagatttcttatataatattcgttccatcacgacacttttacatacacatccggcttctagccctgtacctgtgtgtcctctgtgccattcttccagtcatcaaacttcttgactacggcatcataagtatcctggcaaattgatggcagcttgtctccccaggctcctgttgcctgtgaaaagcccttcttgaatgcattcaaaagctcatcagccttgtccttgttgcctcccgacagtgcctttgcaaagtcaagaatacggtctgaggtcttctcaactccccagtatccatcctctgcgatgtcctttttggcctgcgctattgtgtctgcatctacagtcagattctcaaacagactctttaagccctgtgacttgtcccaggttgaagcctgtcccgtcatggactttctgacgatctcgataagctgctgctgtctggcgttggcatcatccttaagtgcctgtaccagtgcatctctgtctgccttgctcatcttctggtttactgtgctctttgcagtatcctttgaatcatccttgctgtctgatttctcatatacagctgcctcctcgctgaagcctgcagtctttgcatccgacttatccgtctttgcatcctgcttctttgaagcggtattagtattctttgtctgcgcctcgtcctttgctgtgacactctgcgccgctactgctgaaactacacttgaaatagcatctaacatctctcatccctccctggtaatgtgcgtgcgggaatcctttcccgctatactattatcaacctgtatagcgtctgatatagctaaacagtctttctcttatactgtgtatcggctgttttgcgtctgttgcttatagctttagccgttattttttcagctttctgccaaatataaatgtcgaaaaatatattaccgatgcaataatcactatcatcgggcctgttgccacattggtgtagtatgacactgcgaggccgactataccggaaaatactgaaaatatcactgaaaagaaatgatactcacgcatattttccgaaatattccttgatgaagccgccggtaatataagcagagcatttattataagtatacctatccacttgattgatagcataactatgagtgctacaagcaccgcaaacagattatccagaagacgcacatggatacccttgctttttgccacgcttctgtgtatacatatggcgttgagcttattgaagcaaagcacccagaacactatagtgaccacaaaaatcacaattagataaactatctcagtctttgtgatgcttagcacatcgcccaccagtatacttgagtatttgctgaaattgccgccctttgacagtatcgcaagacctatcgccacagagcacgatgaaaataccgatataatggtatctgtcgatgcagtgttcagactgcctatcttatttaaaagaagtgcaaacactatcgcaaatatcaccatggcaagcgaggtgtctgccatgccacataccactccgacagcgattccggtaagtgctgaatgtccgagtgcatctgaaaagtatgccatctttttgtttacaatcatggttcccattatgccaaaaagcggtgtgatgatgagcacagcgataagggcatttctcatgaaatcatattgaagccaggaggttatattcatttgtgctcctcctctctcacccaggattcctctcctgtgtaaaaaattctctcaaattccttgctctcgaagacttccttcacagtcccctgctttgcaacggtcttatcaagcagtacaacatggtctgcgtactttgccacatagtccaaatcgtgcgatatcagtatgattgcaaggtcatagtgagtctttaaataatccatggtcttatagaaaagctccatgccgttttggtctattccggacaccggctcatccaacagcagcagattcggctcgtccatgattgccatggaaagaagcactctctgcagctgtcctcccgagaggttgcacacctgcttgtcgatgagctcctcagcctcaaatacctcgagtgtctcccttatctttgcctctatctttttgctctttggcaaaaaaacaggataattgtactgatagcttgctatgaggtcatacacgctgaccggtgtatttttctcgatattaacagactgcggcacatagccgattttaagcttagccatatgtccgtccttagtatccttgaactcaatcgtaccggtgtgaggtatctcgccgagtatcgcctttatgagtgtagattttccggcaccgttctggcctattatgacattgaaagagccgcaatgtatgtgcatatttacatcctcaagcactgtctgctctccaaagctcactccaaggttatttatttttatgcaatgaaagccacatggctgtattattttccgcatattttctccaattttatttagtaaatgcctctttgataagctctatattgtgctccataccataaagatagctgtccttgtcgtactctcccctgttgagagggtcgatataaatcacatgcacatctgtctcacgcgatacggtatctcccatgctctttccgtagagctcctcagcgagtattaccgacactccgtcatcctttatggcacctattacctgctttatctcacctgcgctgactgagcgctcctcgtcaaggtctaacagatagcatgcattcatggaaaaatcatcagctacatacgcataggcctcatggaatatgatgatattctgtccattggtaagactctttaggctatttatcttttcttcaagcactgcaagctttgcatcatatgcttttgcatttgcataatattcatcagcatgctttgcatccttttcggcaagccgggatgcgattgtctgaaccatggtgcggtaacgcggcacgctcatccatgcatgggcattctcatcaccatggtcatgatcgtgcgcgctatctgattctgcgtctgcttcgtggtcatggtcgtggtcactgtccgattctgtgtctgcgtcgtggtcatggtcgtggtcactgtccgattctgtgtctgcgtcgtgatcatggtcgtggtcactgtctgcatcatcctcagaaagaagtgccacatcctcacaggcctcaaccacatcaagcttcggatacgcctttgccacatctgacataaacgactctataccgactccgtttattacaaaaacatcggctgtggataaaagcttcatatcctccggtgtgagctggaaatcatgcagacaaccggtctgtggctcgcttagattttcaagtctaacgccttccactccgtctactatatttaaagctgcaatatacattggatagaaggatgtcacgacagtaagcatatcgtctgcttcgtcagtattttttgtattgcccgaagcatttgatgctccaccggcagcgcctttcatacctgctgtgtgctcatatgccattaccgcaagcgtacacactatcaatatacacaaaaacataatgcctacaaatttgcatttattcttcatatattaaatattcgcctttctttctataactttatttctttttatgattattaacgctttttttgctcttggccttatctctgcgttctttagtctttttggcaaccggctttccggtcttcttccagcgctcctttttgtgcggctgggatgcagcggctctttttgcagctgattttgcctcgcgctttgcttcttcctcctgtttcatggcaagaagcgtctcctcgtcaaacacgagtgaatctatgagattccagatttcgtccctgccttcctttgacatggacgaaaacggtataactaccgtgcccggcttcacatgaagtacatccttgatagtctttatgtgtgcggcaatctggctttttttcaatttatcagatttggttgcaatgatgatcggtgcaaagccctggtttaccatccagtcatacatcatgatatcattgtccgatggctcatgccttatatctattaaaagaaacactgcctgaagcttttttgaggtgtgaagatagttttctatcatctgtccccatttagcttttatctcgatattggcattggcatagccatagcccggcagatcgaccagatacatggcgtcattgacgttataaaaattgatggtctgtgtcttgccgggctgtgaagagatcctggcaagtgactttctgttcatgagtgcgttgatcagtgacgacttgcctacatttgacttgccggcaaatgccacctcattatactcattgtcagggattgtgcttgtaattccgcaaactgtctctaaattaacacttttaattaccataatctcttcctcattcttattttacaaatgctatcttctccacctgtgaaaatctctccaccggcacgatttccatgccgtctgttatttcttttgaaatctcctccaggtccttttcattatcctttggaatacatactgtttttattccgattaccttggctgcaagtagcttttccttgagtcctcctatcggaagcaccctgccgcgcagtgttatctcacccgtcatggctacatctgccctgacaggtctgtctgtaatggctgagagcatggctgtcgccatagtgatacccgcagatggtccgtcctttggcactgcgccctccgggatatgtatatggatatcatgcttcgtgtaaaactctgcatcaatgccatatccttcgcttattgagcgcacatagctaagtgccgcctgtgccgactccttcatcacatcaccaagcttaccggtgagcacgagctcacccttgcccggcagcacattcacctcaacctcgagtgtgacaccgcccacactggtccatgccaggcctctaacgattccaacctctgcgcgatcatttttcttctccggactgtacttcggattgcccagatatgtcttaagattggtctttgtaacctttacagcagcttcgctgtccttaaagatttccctggcagccttgcggcacagcttgccgatagtcctctcaaggcttctgactccggcctctctggtgtacagcctgataatatcctttagggcagagtctgttatcgtaagctgttcctttttaattccgtttttgctcttttgcttctcaaccaggtgttcctttgctatgtgaaacttctcattttcagtgtaacttgacacctcgataagctccatcctgtcaagaagcggctttggaatgcctgaaacctcatttgccgttgcaataaaaagcacctccgacaaatccacaggcatctcgatgtaatgatccctgaatctgcagttctgctcactgtcaagcacctcgagaagagcggctgatgtgtcacccttgtagtcacttgacaccttatctatctcatccaacagcatgagaggatttgaaacgccggcctgtcttaagccatttactatacggcccggcatagcaccgatatatgtctttctgtgtccacggatttctgcctcatcacgcacaccaccaagagaaatacgcacatatttcttctccagtgcagacgcaattgaacgggctatgcttgtctttcctgttcccggaggacctacaagacaaattataggactctctcccttgcttgtcagatttctgactgccagaaactcaagtattctctccttgacatcctttaatccgtagtgatcatcatcgagcacctgtgctgcatggtcaagatccttgttatccacagacatcttgttccacggaagctcaagtacagtctctatatagcctctctcaactgtgctctctgatgagctgctgctcatatttctaaagcgctttatctcttttttcgtcttttcctttacgtagtcaggcgcatctaactcagatagttttttctcatattcatcagcctccgagtcagcattctcgcccagctcctcacgtatcacaccaagctgttcacgaagcacatactccttctgatgcttgtccacacgaacctttacttttttctgaagctcattctttatggaaataacctccacctgggagagaagtaatgatactataacctgatatctgtcattgatatcctctgcctcaagcacctgctgcttaagctcatatgacaccggcagattgttggttacataatcaatgagcttttcaagatcctcatactgatctatctgtctgataagctccttgctgattttgccgacgactgccgcatatctgtgaaaagcctctctgactccgagaagcatggcttccctgagatcatccggcaggctgtctgcattactatcacaataacagatttctgcctcaaggtacttctcattaccggtaaagccaagcaatgctgcccggcttattccatctacaagtattctcacaacatcattctgtaatctgacaacctgctttatgtcagcaacaatacccatctgatagaggtcttcctgagtcgggtcctcactgtccacattcctttgtgtgacaagataaatcttttgatcctgctccatagcctcctcgacagcacgaagggagcgctctctgctgatgtcgaaatgggcaatcatccccggcagaatagtaagccctctcagcgctactgcaggcatattcataatctgttcttccacttatatctcctgtattattgcacagccatgcataacaaaccgctgtgcaatttatattatccgatgctgtatcttttgtaaaataccgccatgtacttatgatgccgctttttcctcgatatatgcctccggcacacactcaccatctagctttaagttttcctcaactgtatccttgtcgattacgcacttgctgatgctcttgtctgacggtatacgatacataaggtcaagcataacagcctccatgatggcacgaagtcctctggcccctgtctttctctcaagtgccttgtcagcgatggcatttactgcatcgtctgtgaactcaagccctactccgtcaagctcaaaaagcttggtgtactgcttgataagcgagttcttaggctccttaagtatacggataagtgcatccctgtcgagtgcctcgagagaaacggtaataggtacacgtccgataaactcaggaatcaatccaaactttacaaaatcctgtgggagtgcatgcttaaacgcctctcctacattgagctctgtctttgactttacatctgaattgaagcctatagatgatgtatccatacgactgtcgataattttttccagaccatcaaatgctccaccgcagataaaaagtatattagtagtatcaataggaataagctcctgctgcggatgctttcttccgccctgtggcggtacagatgcctctgtgccctcaagaatctttaaaagagcctgctgtacaccctcgcctgacacatctctggtgattgagacattctctgatttctttgtaattttatctatctcatctatataaatgataccatgctctgcacgctcgatatcataatctgccgcctgaataagctttaataggatattctccacatcctcacctacgtatcctgcctctgtaagtgttgtagcatcagcgatagcaaatggaacatttatcactctggcaagtgtctgcgcaagaagtgtctttcctgagcctgtaggtccaagcatgagaatattactcttctgaagctctacatctgatgtatcacctgccagaactctcttatagtgattgtaaacagcaaccgaaagcaccttctttgcctggtcctgtcctattacataatcgtccagaaacgccttaagctcctcaggagtaacaagatttatatcatccttagcgctgcttttgtcctcatgcccctctacgccttcttcctcaagaatctcagcacatatatctatacactcatcgcagataaaagctccattaggtccggaaatcaaacgatttacctggtcctgtgtcttaccgcaaaatgagcagcgaatctttccgtcgttttttcctgccattattaactccttttattgcatgagggcatcccatatggggtaccctcttaaattcatctaacttctgattatctgtttgttattacactgtctatgagaccatactctgcggcttcctgtgctgacatatagttgtctcgctctgtatcagctgcaattgtctcgtatggcttgcctgtattggctgctaaaatttcgtttaatctcttctttgtctttaaaatattttctgcagcaatctgaatctcagtagcctgaccctttgcaccgccagatggctgatgaatcataatctctgcatttggaagagcatatctcttgccctttgcaccgcctgcaagaaggaaagctcccatgcttgctgcaagaccgatacagattgttgaaacatcacacttgatgtactgcatagtatcgtaaatagcaagtcctgctgtaaccattccacccggtgaattgatgtaaaggtggatatccttattcggatcctcggactcaaggaataaaagctgggcaacaacaaggctggctgttgtctcatttacttcctctccaaggaaaatgatacgatcttttaataatctggagtaaatgtcgtagttgcgctctcctctgctggtctgttcaatgacatatggtactaaactcatataaaatacctcctttataaaagctcaaaagaccggctcagaaaataggcttctgagccagtcaatcaaatcttgattcaaaaatcttattcttctgtagactcttctgcatcagcctttttctttgcctttgcacgctctttaacgttgtccatgataagatctacggcctttgtgatagcaatgtctttcttcatagactccttctcagcatctcccatgtactctttaagcttatcagcctccatgccgtatgccttagccatcttctctacctcagcatcgatatctgcatcagtaacctcgatgttttcctccttggcaatctgctcaagtacaaggctgctctggatacgtgttgtagcctcaggacgaacctgatccttaagctggtcaactgtcatgcctgagaactgtaagtactgctccattgtaagaccgctctgtgcgattctctgagcgaactcctcaaccattgtctcacactgtgtctcaatcattgcctcaggaagatccatctttgacttatcgataatcttctggatagcctcatcctctttagtcttcttagcttctgtctctttcttctctgtgaggttctttttgatttcctctttgtactcagctaatgtatcaacacctgctgcatcctgtgcaaactcatcatcaagctcaggaagctccttagccttgatctcgttgatcttaaccttgaatgtagccggctttcctgcaaggtctgctgcctgatacttctcagggaatgttacattgacctcaacctcatcgcctgtgttctttcctactaactgatcctcgaatgtatcgatgaatgtgtgtgaaccaatctctaatggatgattctcaccctttccaccctcgaaagctactccgtcaacaaatccctcaaagtcgataactgctgtatctccctctgctacaggacgatctgtaactgtaactgttcttgcatttttgtttctctggttctcaagctcagcgtcaacctcttcatcagaaactgatgtgtcgatctttgtaactgtaacgcccatgtacttaccaagagtaacctcaggtcttacagcaacctctgctgtgtagatgaaaggctgtcccttctcaatctgagtaacctcaactgttgggcgtgaaacaatgtcaacaccgctctcgtcaactgcacctgcgtatgtctgctgcataagaatgtttgctgcatcctcgtagaacacacctgctccatacattttctcaatcatagctcttggcacttttcctttacggaatccaggtacactaatctgtttcttctgcttctgatatgcagaatccaatgctttctctaattcctcagctgctacctcaatagtaagcttcgccatattatgctctaaattctcaacctgtacactcatgtcaatcgttatcctccttaaaaatatatatgaatggtatgtacatcaaatgtaatgtgggcatgctttttaaactgctaagcccagtcattggatgattataacacaacaaatccactatttccagtgttttttacattaaatttgcttttgtgtataattccataaattgtcagcaataccaaaacatatttttgtcattttacggcataatatttccatacacatacagcttgtgtataacgttttaaaaggaggtattgcattatggcagcatcaagtagtaaaaaggcttctgtaccggaggcaaaagaggctatgagccgtttcaaggaagaggttgcttcagagcttggagttcctttaaaagagggctacaacggtgaccttacttctaagcaggccggttcaatcggtggcgaaatggtcaagcagatgatcatgaagcaggagcagcagatgaaataagctctgcaatagcaggcttcaaatgtacgcttcaaatgcaagcataaaaagaggccgcgcaccatggggttggtgtgtgacctcttttgttataatactaataatatgattatttgctgaacgttgtattagtataccagtccctgtcgaatatgctctactgtggcatcgtctgtgaagtatctgacaagctcgagtgcaaacgcaatagctgttcccattccacgacttgtaatcacattgccatccacaactacaggctgctcaagccattgtgcaccgagcagcttttcctcaaagcccggatgacaggtagcttttttgccctcaagtatatgattctcaccgagcacgctaggcgctgcacatatcgctgcaacaagttttccctcagcggcaaatctcttaattgtctttactacggtctcatccgcgccaaggtttaatgtacccggcatgcctcccggcagtacgattgcatcgtagctgtcaaaatcagcctgtgcctttgtggtatctgtcttaaatgtcacctgatgagagcttgtcacctcggctttttccgtgattgatatggtttcaatctcaagctttgctcttctaactatatctactactgtaagtccttcaatctcctcacagccgtctgccataaaaattcctactttaatcatatttttctcctttatttttctttgataatactatgataccttttgaccctttaatcatactataaaaatctgcggttcgtccttgaatttttaaataccggtcattataatcatatataaatgatatgagggtaaaacaaaaatataaaccgtaactataaatctaccagtaacctgaaaggatataccatggaaatcgaaagaaaatacttacttaaacagcttccttccaatttagacagctacgcgagcaaaaaaatcgcccagggctatctgtgcacctcgcctgttgtcagagtcagacgctcaaatgacagctattatatgacctacaagggagccggtcttatggtgcgtgaagagtacaatcttcctctcacaaaagaagcctacgaccatcttgtccaaaagattgatggtcgtctcatcgaaaagacacgctatctcatacctcttgacggtggtctgaccgcagagcttgatgtatttgagggtgatctggctcctcttacactcgtggaggttgaattcgactctgtcgacgcagcaaatgaattcacagcgcctgactggtttggcgaggatgtcactgaatccggcaaatatcacaacagctatctgagccgattggaaaattcatagtactgcctggtctttatcgtattctttaaatcatcataccgcttttgcaatgggccctcaggaactacaacatccataaccaccgctatgtcatctataaggcggtcggttatgatatccctcattgaaataagtatattgtacttctcttcaaaggtatccgcatcaaggaactccagcaaacgcggatccggtgcctggccttcatctgcatccggtgccggctcataacatgcccgtgtctgaacactaacagcttcaggtgcattagcttcaatcgcattagtgttcaaagagatactctttcccgacatatcctccggctgatccttaagtgtgatcttctcaaatctgtatttctgcttcacatcaggatatttctcatggtccacctcgcttacaaacatgtcgagtggtctggcgtatatcccaaaatcatcatataaagcctgataaatcacaagcttttcccctgtctctgaatgtgtcgccactgtaactatctgatacagcttattcttaaagtgcctgtaaagctctccgggctttggtgttctgtccatcatttctgcctctttccttattatttaaaagttgttaatcatgtctaagccttccccaaggaaatctctctcaaactccagattaccgctgtatcccatggcaatcagatcctcaacactgccaaacatgctctgtgtctcagcctctataatctttgcaccgtctgccgctttggtatgcagtgtctggcagtttcttgagtgctcctgagccattctctgctgtgcctcgctatgtccgtgcatagcctcaagctctttttgtgtcgtatcatccgcaaagcgtgcgttatttttcacggccctctgcactatatccggattgctctgctgtggtctctgctgtggctgtactctctgctgcatctgtggtctctgaggctgctgtgctctctgctgcatctgtggctgtggtttctgctgatatgtctggttcaatgcattcatacccgactgaactgtattctgcatgctgttccatatctgctgtatctgcttctgctgcggtctcggtttgtttggctgcgtgtttttgctgcctgcgctctttgattttttgttaatgtaaaaaacagctcctaagataattgcccaaattataacatccatattctgctcctttatcaatctgcattttctatgtcaatccctgaatatcctgcacatatcgcgcagtatgtattctgctgtctgttccggctcccattgctttgtaacacccacaagcagcggattaagctccgacagtatccttgccgtgcgccggtctgtcgtgccctcatacttatcgtttatggcctcagcctgcttcacacatgcctcaagctgctttaatatatccttccagaactcctcgtaatatatctcatgcactctcttagtcttttgtgtgaaatttagctctgcaagctctttgttgctgtgccccagatagaaatatgacagagcaaacaaatcaggctttttcctttcaagcccctcatttgtcaggtgtatcagattctctatctcactctgtaaaatgataccgttgtcaaaggatgacagatatctctccccctgctttacaacagagtccagagtcgtgtgaaaatccgtgtccaccttgctgattaaaaattcatcgtcaaacatgccgcttttcgctttgcaagcctttatcagctctccaaagtgcttccggtcggttcctgtgagctcacaatacccgataacttgttgctcaagctcctttaaatctgaaagcaggctgcttaagcctgtcttcacgccataatagcgctttgcaacaccggaggaattctttttggttttgacatacagcttaagccagctgttgaccactgtcatgtcggcacccgccgtatccatcgctgtcttaaatttcttttccgtatcacttagtcctaaaatcatcacacaccctcaaacatcattctaaaactatataataacaattctacaccattatcatatttttttaaagagccttttttcgctctgaaaagcccactttaaacgcaaaaaaaggaagccatacaataactgtatgacttcctatatactcttcatgttattcgcatcgtcgtgcaaatggcacgagcggctttgttatgatagcaaaatcagattaacgaccgaactgcatatcgttgttacctgattttgttgtgaacatctcaagcatgttgattggatcgttgtaatccataagccatccctcacgggcgaaatcaaactgtccgtccttacggctgttaaggaatacgttccactcctgctgctcaacctttaagttgatacctacctttgaaagatcagcctggatagcctcaccaatctttacattggcctctgagttgtttacgaggtatgagaactcgacagtctggtttacctggcctgtgctctcatctaataatccgatagaagcaagaagctctttagcctcctcaaagttcttatcgtaatctgtgccgtagtagtccttgttcttgaattcgccaccgttaccatctgtaacgccctctgggataaatgttgtggcaatcttctgtccgccctgggcgattgtatcgataatgtactgacgatcgataagaagacagattgcttttctgaataccttagccttgtcagcatctaatccaagttctgagtagagcttagaattaatgttgaagcctacgtagtatgttccaaggttgtcaactgtgtagaactcgcttgtcttcttagctgcctcaatctcggctgtaggaattgaatcaataaaatcaaggttaccgttctggtaagctgtgtaagctgaaacatcatcagatgtaagcattacgttcatctcatcaactgttacattgtcagcatcccagtaattaggattcttaacatatgtcatgcttgaatcatgcttccactccttgagtgtgaatgcaccgtttgtaacgaacttgtcgcttgcatcgtttgcccaatcatcatttccctctactgacttctggtttacagggaagaagaatgggaatgcacataagtcaaggaagtatggtgtaactgctttaagcttgactgtaagagtctttccatcatcagaagcaactacatcatcagcagcaagcccctttgtatcatcatatcctgcgaatactgcgcaaaggtagctgtaatctgcagctgtcttaggatctgctgctctcctccaagaccactcgaaatcctttgcagtaagctcatcaccatttgaccacttaagaccgtcacgcattgtgaatgtgtatgtgaggccatcctcagaaacctcatagctctctgcacatgcaggctcaagcttgccctcagcgttgtaacgcataagaccctcaaagctgtttactgcaagacatccgccgtcaacagtactgtttaatgcaggatcgatatgatcaggctctgatgccatgaagatgtttaactttccggcattctttgtgttctttgcattgtagaagtatttcataccctctactgttgagtatacgcctgtgacataatccttgagcatatactggtcattgtagtagtaaagtggaataacacaccatgtatccataagcatatcctctgcctggtgcatcatctctgcacgctttgcaagatctgcttctgtacggatagaatctactaactcgtcatagcttgtccagtctaccgctgttgatacagcagtattagaagtatcgttagtagttgttttgttgttgctcttgcttccacaagcagtcatgccaagtgccatagctgcaacaagagtaagtgctactaatctctttttcatctttcttcctcctaattaattaatatgaaaaataaatttatgttagaaccggcacatgtggcttaagctatatgccggtaaaaaccttatattagcggttgaagcatgcaaccatatgtccgtttcctctgtctgtaagctccggacgtgctgctgcgcactgttctgtcgcatatttacaacgtgaacggaacggacagccgctaggcatgcgaagaggtgaaggaacatctccctcaagcacgattcgcttgctgtgtctggcagtctcaggatccggaatcggaaccgctgaaagcagcgactgtgtgtacggatggattggattgtccatcagctcatctgcatctgcaagctccatcatatggcctaagtacataacagctattctgtcagagatatgctgcactacaagcagatcatgcgctataaacaggtatgataaacctctctccttctgcagatcctcaaacatgttgactacctgggcctgaattgaaacatcaagtgccgataccggctcatcacatacgataaacttcggatctactgcaagcgctcttgctattccgatacgctgtctctgtccacccgaaaactcatgtgcatagcgtgtggcatggtctgcgtttagtccaactgtctccatgagatccataatcatctcatggcgctctttcttgctattgtagagcttgtgcacatcgagaggctctccgatgatatcctcaaccgtcatacgagggttgagtgatgaatacggatcctggaataccatctgcatctgcttacggtaaggatgcatattcacatctatcttcttctcactgtcaaacaatacattgccgtcgaactcaatgcgtcctgctgtaggctggtacagacgtaaaagagtacgtcctacggttgtctttccacagcctgactcgccaacaagtccaagcgtctcacccggctttatggcaaatgacacatcatcgactgcctttaattccatctttttaaatccgtcatgaacagggaaatactgcttcaaatggtctaccttgagcaggtactcgttgttatttgtctcattactcatttgattttccctcctccatcatattcttaatattcatccagcatgatgcgagatgatcctctccaacccagatttcctccggcttttcggtgagacatatcttcatagcggcatcacagcgagggcagaatgcacagccctctggcatgttgagcatattgattggtgtgcccccgataggaacaagcctggtttttgaattggtctttgtagggattgaacgaagcagtccctttgtgtactcatgcgccgggctgtagaatatggcatctgctgttcctctctcacacacacggccgccgtacataactatgatctcatcacatattgaagcaatgacacccagatcatgtgtaaccatgatgatggccatgccgagcttttcctgcagtgactgcataagctcaagaatctgtgcctggatagtcacatcaagagctgttgtcggctcatctgcgataaggatatccggctcacaggctaatgccatagctatcatgacacgctgtctcataccaccagaaagctcatgagggtactgatttacacgcttctcaggctcatttactcctacaagtgtgagcatctctatagcacgctcttttgcttccttctttgtacggtctgtgtgaagaagcactgcctcctcaagctggtagcctaccgtaaataccggattaagcgatgtcataggatcctggaaaatgattgaacagcattttcctctgaaatctgccattttctttttgttccatttggtgatatcctcacccttatattttactgagccgcctgtgatggcaccattctcagcaagaatctgcatgattgaatatgctgtaactgactttcccgagcctgactctcctacgattccaagagtctttcccggctcaagcttaaagctgacaccgtttacagctgatacgtctccgttatcggtcttgaaggtagtgtgcagatcagatacttcaagaacaaacttattatcttccatcttactcactccttactatttcgataatttagggtcaaatgcatctcttaagccgtcaccgataagattcaatgtaagaacaatgatacaaatcgtaagcgccgggaaaataagacgcaatgggtagctctggagtccgccacgcgctgtatttgccaacgaaccaagtgaaggcataggagccgaaacaccaagtccgataaatgacagataactctcagtaaagatggctgatggtatctgaagcgctgtagtaatgatgattactgacagacagttcggtaaaatgtgttttctgatagtgcgggctgatgatgttccgatacactttgctgcgagaatgtactcattctgcttgatggtaagaatctgacctcttataagtcttgccattcctacccagtaaagcaatccaaacactatgaaaagtgcaatcatgttgacaccgagctttgaaagcactgtaccctttattacaggtgtcagcacctcatttaatacaactgcgagtaaaatgatgagcagcatatccggcaatgaataaatgatatctactattctcatcataaccatatctaccttgccaccgcagaagcctgatacggaaccgtaaatgataccgattataagcacaagcagtgatgcaaacacaccgactcccagcgaaacacgagctccgtaaacaacacggataaaatagtctcttccgagctcatctgtgccaaaaatgtgcgggaacagcttctcacctgcatcaatctgtgcctgctcagcatcgctgtactggaaaggtcctaagttctgtgcacccttaacgatatctgcatagccgtaaggcacaatctttggtgccagaagaataaccaaaataagtaaaaccaaaactataatagaacccatagccagtggatttttgcggagtctcttaagaccatccttaaagaaggtagttgactcacccataacctcctgctggcgtttctcttcatctgatgccttggcaaaatccttcatatcgaacttgctaaggtcaatctgtgtggagaaaggagctctcttcatattatctttcatctttatctctccttaatcaagcttaatacgtggatcaatcactttgtatacaatatctgtaatgaggttcgcgcctaccatgataacagcaaggaaaagcgttgtggccataatcattgtgtaatcacggtttgtgatacagcttacgaacttggaaccgagtcctccgatattgaaaatactctcaataaccattgaacctgtgaggataccaccaatcataggtcccacatatgtgatgaccggaatgagcgcattacgaagcgcatgtacaaatataatcttgtactgatgtacacccttggcctttgccgtacggatgtaatcctgtccgagtgcatcaagcattgaagtctttgtaagtcttgtaatatatgccatcggtgaaagcgacagtgacagcaccggaagtaatatcatgttgcttcctgagctgaaagcctgcaccacgccaagctttatacagaagaaataaagtaataacgtagcgatgacaaatgacggcatcgacgtaatcagtgtgacgaagaatactataactcgatccggccacctgtttcgcatcagcgctgctatcgaaccgagcaccactccgaatactatcgcagtgagcgccgctaagagtccaagcttcgctgaaatcgggaagctctccccgatgatatctgagatcggacggtctgtcttaagactaacaccgaaatctccgtgcagcacgcctgccatgtaattcttgtactggactataagtggctgatccagtccgtagcgtgcctcaagctctttcattaccgccggactctttgccttctccgaattgaatggaccacccggaattgcattcatggcaaagaatgtaataagactgataatgaagattgtaaaaatcgcgagaataactctctttacaatgtacttacccatatttttctctccctcttggatttgtatcgataatgcattatttttattttttaaagcattatcactgcaccacgtcaaagtattttgtctaatacgcaaaaaagtgcgaatgacctcattgtcattacacactccctaatcttgctgtctgatacaactgtcgttctgacgcgaacaattcctttttattatacacagaaatcatactttgtcaattggatatattttcctatattgttttcatttctgcataaaaattagtcattttttataatactcattaataagggtaatttatgcagtttataagcattatttatacatttttattcatttttatttttgcattaaaatattaattttcagtgcatgattactttgaattgttaagtaccggcgttattctggcattaaacggatatttggtgtataattacatatcattatatatcaaggagccacctatgcttacatacgacgatgcactcaatctcaactactataaaaaaacaacctttaccggctggatgaacggcatgcgctttctcataaagcgtgaggagcctgtcatcaaggaagccacagaggatacacccgaagaaaagggtgagccaatatttcatgcctggatatggccggggccatatatttttgacctgaccgacgacagcaaaaagactgacaatacctttccatttacagatgacggaaaaaaacagtgtgtagactggattaatgaggtcattagtgcacactcaaacgaatatccgaaaaataaaacagatggagaaaacctctaaaaaactcttgacttctcaccaaaaatattgtagtatacgttttgtgcaaaacacaagggcttgtagctcagccggttagagcgcacgcctgataagcgtgaggtcggaagttcgagtcttctcaagcccatccttgtaataagcgtattatgaaagccacggattgctccgtggcttttgttttatgtgtatctacacctgcacaatgcgtccgtgtctgcctattcctttaaaaaatcccgcatttattccatcatacttttttaaactgcactcagaaatcatgagctgctgcttatatttgtaatcatcccactcgagaattgctgtgacgtagggctgttcctccattacacgcacagtagtatttttctttgaaaacacagggtattttccggtgtatcccttttgaagcagctcctgttcaagcgctttacgcttttcttttatgcgttcatttatctgatttccgtaatttctctccggataatcctttgatgcctttatcacaagcttataaatatactgataaagtggtactctttttgcatcggctaaatgtctgctcaaaagcttttccgttttctcacatggatttgccctgtagcgtgcaatgagcttaagataatcagtgtccgaaacctccctgcaaagctcctccataatgtctattccctctacgcgggccggaaaatgatactccatcaaatcgccgggtaccggtgtccatctgcgaaacggtgcaaagtaaataaggctctggataaagcattctgtctcgttgcagtattcctttcccatgtacatatacttgtccgcgatggttcctaccatatatacaagcatgcgccactgctcctgtccctttacccagaaatgtcctatttcatggtatttaaagcatgcctcatgcacatgcaaattatcaaaccagagtgtgatcacattgtcctgctggtgaagaatgagtccataacctttttcacttcctaaaaccaacgatgccgaaataatttcttcctcgctatgataatcgccctttaacactgcattttccacagtcagatagcattccaccgcgtcattcatgatatatgggattatatatttgtcgtcacttctgcatatatcaaatgaaccgtaatcaaagagttctgcgagcatgtaaaatgcgcgtggcatatcctcttttaagccgggaagtgcttttactaaatccttgtaagcctgcattgtggtatcctttcgtataggaaaaatgataaaaaaataagaatttcagaagtaataaaaacctctgaaacccttgtaaacagtacgggcaacaggacttgaacctgcacggtctcccactagaacctaaatctagcgcgtctgccaattccgccatgcccgcaaacactttgatagtatatcattttgtttcatgtgtgtcaatattatttatcacattacaaaagtgaactattcacattcaaactgtatttccacaacaaaccgcttcccctcaagccttgcttcaatactcccgcccattctctccacaagttcctttgcaatcgaaagtccaagcccgctcgatgatatgctcctcgcttcatcagccttgtaaaagcgctcaaacaccttgtccacgtctatatcatcaggattttttacatcatttgaaaccaaaatatggacaatcctattttttgaagtacgctcgtaatctgaagccctgcaattgcacgaatcctgctgcctcatctgtatgcagatgctcttctgcccatgcaccagcgcattttttattacattctgaaacacccgcctgagcgcctgcacatttgcagtgataaatatcgtgtcctcacatatatcaagtgacggctcaatgccctgctttttccactcctcataatacgaaaacactgtctgctttaaaagtctgctgacacagcaattagacagctctagcttgaagctgtcatttttaagctttgtgaacatgaaaagctcctcgagcatatccttgaggcttgtgatgcgctcctgtatgatatctatataatgctcctgcgcgctcttgtcagtctcatccctaagcagctgaaaatagccgtccagtgaggtaagcggagtacggatatcatgcgacaggtttgtgtacgtgtcagatatcatctgctccttttttgccgccgcctcacgctgcctgtgccattgctctaaaaatctgtttatacgctccttaagccttccgatatcagccatgttggtatcggttaaaaggagcatatttgtatccttttcgcataaaaaatcaagctgttcgttaatgtcacgaagctgtgcccttatttttacgagcacagctattaagacagctaccgaaactgcaagtattacagtcagtattttccaaatcatgttttattcctcattcaaaacacattatatatccctgcgtttaaatacaccgtacactgcaatcagtgacaccactgcccacacagcggctaccgcaaatgcaccgcctacggtctttgcagacgcactcagatcaagctcagaaatctgattaacaataaggtaatcatttatatcaaagttctttactccgattttttcaataagtatattgattccactgaaaatcagtgtaaagatacctgtacacatgcacacagcgataatcatgctaattacattgttttttataatgattgccattgccatgacaaaatatacaaataaaagtgtgaccacatactggctgccaagcatcttaaataagtctgctgcatctccgaattctgctccatgtaaaaacagcggtgtcgcaatacactggacaatcacatcaagtgccatggccacaaaggtaaataccgaaagcgctatcatctttgaaaacagcaacactccacggcacttcacctgtccgcctacgctctttatatagccgctgtttaggtctgctgttgagaagagcaccgtaaatatcgcaagtaaaagtgccaggtcaagacctgctatatcgctttcaaccatatcggctatggtcggtacctcatctgacatgtcggattcatccatttcaagcccgactgttgccgttggtccatttgacgattccgctgatgctgtatcgtattcatctgctatctcactgtctgactcacttaccatagtgacatcatcagttgtttccacgatgctctctgtcgccatgcttctgacaagagctgtcataccgctcatagctattgcgagtgccatagctattacaagtataacataagctgactttgtatgtatcagtctgtaaatatccattcttaccgcattaaacatttgtcgcacctcctgtgatactaaggaaatatgtctcaagctccattcctgtgaccgctagctgtgccaccgaaactcctgctgtgaccagcgctgtatttaaggcggcgctatcattcaggcgctcatagacatctatatgatttttgtccactatcatgtagtgcacaaagcccatcttatcgagcacaggcactgctttatttggattgtccactgtcagtgtaatcttttcactgcacttggaaagcagctcctctctggtaatttcctgaagcagggctccattatttataatgccgtaatctgtggcaagctttgaaagctcctccaatatatggcttgaaataaacacagtcatatcctgctgtgcacacagattctgaatcgtatcacgcacctctgcaattccctgtggatcaagtccgttgataggctcatcaagcactaaaaggtcaggctctccaaccagcgccatgccgattccaagcctttgcttcataccaagtgaaaaattctttgtctttttctttcccacatttaacagacctaccttatcaagtatgccctctgcatagccctttttactgatgccgaagagacggcacttcatctcgatattttccttcgccgtcatgtttggatatacacccggtgcctcaatcaggcagcccactcttgagcgtacctttgacaaatcctttccagcgtatccaaacatagatatctctccgcttgtcggctttgccagaccaccgatcattctcatacaggtagtcttgccggcaccgtttctgccgataaatccatagattgcaccctttttgatgtggatatccacattgtcaactgccttctggtgcccatactgcttggtcagtgcctttgtctgcaataatatttcactcacaatcaaatctccttttcttttttccttagcaaccctttaatcataatataaatgtaaaatcctaatacatcgctaacaaaaagtaaaaaaagagtaaagcttgtttacctttactctttcattttgtagcctatgccccacacagtctctatgtactcgtcatcggtcagcttttttatcttctttctgatattgctgatgtgcacatcaagagtctttgtctcgccaatatacggctcatcccaggcatattcaaatatgtcctccttggcaaacacctgtctgggatgcgccatgagaagctcgagtatggcaaactcctgctttgtgatgccgtcaacagcgttatctgccacgtaaagctgtcttgaaatccgatcaagcacaagctgtctgtgctctattttagcaggacccgctatgtatgtatttgcagtatctccctgcccggtctcattttctgcttttgtctggtttcctcctgccttgcccgactttgaaggtacatctgccaccgcatgacgcagctgcacagccactctggcaacgacctcctttatctcaaacggctttgtgatgtaatcatcagcgcctgccacgagcagattgattttctcatccagctcatcctttgccgtaaggattatcaccggaagtgacgcatccatctgccgtatccgtgccagaagctcctcccctgaaagccccggaagcatcagatccaatagcacaagcgcataggcttccctgtccagcttaagcaaaagctctccctctgtgcctgaccatgcctgtcttgtcctatatccggcttttgagagcgctgtcgcaagcagatcattaatgtccttgtcatcctctattatgagtatctccccggatttgttgtctgtcataatattccctttctatatctattgtaccacttctataataacacctctatactgacaaaatcataccggacgcatttatctcactatgcgtcctattcatttgaatccgctattcagttgtttttgcaaactttagtttagtgccaatacacaccaaaaaaacaacagtaactttttttattctagaaatatccctcgactccctgcaccagtccgtctgccagattttcaagtgtggcatcgctgtggtcagagcatgcgttgccaagctctacatccactgatggtaccgtgctgtatgaggtctgtgtcaggtctatcgccattgagccattaccgtttatctttgctccatgagcgcgcagtccttctatcaggcttgccccaagtgcatcatgctgctgccagtgtgatgcaaccggctccataccctttatgcctcccggcactgatatgtaaaagcagcccttatcgtagcttagtccgtcgccatcccagtgcagagcaatatgacagtctgccgcattattgcagatgacagtacgtgccacattgtcaagctgtacatcacttccgtctcttaccataagcacatcatagcctgccgcaagcagcttgtcctttaatatctgcgccatacggagtgtgacagagctctccggtgtaccgtcattaaaggacataccacctgaaactgctactgcttttgttgcacctgcgcctgttgtaccacctgtggtctttgcagagccgtccggatgacaaagagtcttcaccgaagttcctccacttgtaccgtgtcctgcattgacacctacaactatatttttgcggtttgctgtagccttgtacatgaccgcacagcctgaatttatcgctgaatgttctgcatactgccatgaaggatttagtgacactgattctccattctcataggatgctctttctacatactgataagaggaattattatcacctgaattgttctgctcctcgtccggctgttcggcagtctgttcttcctgctgcgcttctgtctgctgtgtttcttttgcggcctctgttaccacctctgtcacggcttctgtttccgtaggcatctcaaccttctctgcagcctgtgtctctgttgcaggctctgtcggtgtatcctgtgcttttttgccgcatgatgcgagggtaaatatcatcatgcctgtaagtaatattgctgtaaatcgtttcattttttaaaactccattttctttttactacattatagacaaccccatgatattgttcaagtattaggcaacattactttcattttaggggccagttttaaatagtcaatagaaattgtatttcctctaaaaatcagttatactatatgtgaatgcatcgaacatattttaacttgggaggcttgcatggaaatattaaaactgcctgttggaatcgaaaattttgaagatatacgaaggtctggattttattatatagacaaaactatgcttatcgagcagactttaaacaattggagtaaagtaacgctgttcacccgtccaaggcgctttggaaagactcttggcatgagcatgctgcgctcatttttcgagattggcactgacaaatcactgtttgacggattatatatttcacaagataaatctctttgtgatgagcatatgggcaaatatcctgtgatatttatttcacttaaggatgtcgagggtttatcatatgatgaggcatttcaggtattctccagaattataggaaatgaaatcagcaaattctcctttttggcagaaagtgataaattgacagttttggaaaaagaacagttcaaaggattacttcatatagaaaagggaaagtttatttttgacaaggatacatttaccgcttcattaaagcttctttcccagcttttatataagcattacggccaaaaggtagtcatcctgatagatgaatacgatgtgccactcgacaaggcataccaaaacggctactaccatgagatggtctctctcatacgaggcttgttcggacaggcactaaagaccaacgattacttacagtttgctattttgacaggctgtcttcgcatatcaaaagaaagcatatttacaggattaaacaactttgaagtcgtttcaatcatggattcaatgtatgacgagtgctttggctttacagataaagaggttcaggaaatacttaagtattttaatctttcagagcattatgcagatataagggaatggtacgacggctatcatttcggcaacaccgatatctactgcccgtgggatgtcataagatattgcaagagcctgtgtgcagatcccactgcaaagccgcaggacttctggtcaaattcaagcggaaatgctctggtcagaagcttcattgacaaggccgatgtccagaccaaggatgagattgagcgcctgataacaggcgaatacattgaaaaagaaatatcccaggagctgacctacgatgaaattgacaaaagcatcgcaaacctgtggagtgtgctcttcaccaccggttacctgaccaagcagggcgtgactgacgatggcaaggtgcgtttatcaataccaaaccgtgagataaaaaaccttttcatcaaaaaaatccgcgaatggttcagcgatacaactgcaaatgacggaaagacacttgaacaattctgcaatgcatttgtggagaaggatactgaaaaaatagaagagctttttggcgattatctctggaatacaataagcataagggataccgcagttgccaaagataaaaaagaaaatttctaccatggtatcctgctcggtctgctgggctacaaagcaagctggctcatcaaatcaaacaccgaatcaggcaccggctacagtgatatcctcgttgaagttccaaacaaccgaaccggcatcgtgatagagcttaaatatgccgaaaacggcgatatggacgcagcctgcagtgaggcactgaaacagattgaagaaaaatcatatgtggataagctgaagcaggatggcatgcgcaatttcatcaagtatggaattgcttgctttaagaaggattgtaaggttgtggtaagtgaataaggcacgcatttaaacaggcgtagagagactagctccacgcctgtttactattcttttaatacacattttgtaagtcaatatattaattatttctttctattatcataaacaccaagtacttgtactattaatgcaagcaacataataataaataaacctatactatttccatataaaaatatagtaaatgcctgtattgcaacaactacccagttacctactaataaaataagttcaaggttatttttcattttcattttctccttttcttaactttttatataaactagcaaatggtaaaatgttgaaagcaacactttctaaaaatactctataataaactcaattactttcttaaactttccttgaataatcattccaataattcccactataacaataattattcctatataaaacataacatatgaatcaataaaccatgttgttatttccattattgcacatcctatgacaaaaatcactactgacaaattagaaattatttttttcattttcccacgtccttgttctattttcctaggtgcctcatatttcttagctgcctcatatttgattaatataatcatcaattttatttttcacatacaataaggtattcctatacctgcccggaatatttgcccaacagtcatatagcagaatcatatctttctttttattaatttccaattcttttttccattggtatgaatcaattacttgaagaaaataatcgaaataatctctccacaattttgaatattgtcctacatataatttcattctcagtacaacattacggatattgcctacgtaatcctcattcttgctaaatatagcataaaatacatacagtgtaacaatatcaagttcctttatatccggcgaagtactgatttcctccggttccataaaaagactttttaatatattgtttacatatgccggttctgtataatcattatcatatatattcttagccagtctcctcttaaccatgccaagaacatagtttttatttatatcatcatcatagaaattttccaccctgcaatcatcataaactttattcaaatacaaagctccattccctcttctgatgttgcgaagcttgaaattatctccatgaaatttccgctcataaatcatgtccaatgcttcaaactctgcaaataaaataatcactatcagcgctcctgccggtttaaagcataaaaacaaaatcattacactaataccaaaaatatatcttccgatctttcttgcaattataccctctcttaaaattcgaatcatctcttcatatgaaaatctgttatactcttcatcatcaataaaatcacaataaacaacctcaggtttttttccaattttcatctcgagcttcccatctacactatttataagaaaagggaaaatgcataatgggcactttattgaatacctgattctcaaatataaaaatctactcaatgctgtaacctgtagcattataatatctgatactgtaactgaaattacaaatatagtaaacgatactatccaggtgtaaaaatctcccttagaaaataaaactctgtaatctaaaaatgtactgacaacaatccccattattgaactacaaaatataccaaaccaataaaattttatacaattaataccatttcttagcattatcaccatcctcctcaactgttgttaatttctttatatcctataattcatatatcttcaaccataaatacatgaatgacacgaattcgtacatgtttgacattcaatcaataatattcgattatataaaaacagtaccacttattctaaattgttttcaacaccttaagaatgagcggtactttttttgtaatgaatggtagaaacatatttagcagacttatttctaagataaaaataacatgagactgttatttattatttttataattcttaatcacaattaacacgcagcttattattgataacatacagcagaacagcaatgcaatacatgtcacaatattccctctgctcggatgattgtaaaaattcactccatacattatcgttactattcctatgcacgaagtaattattcctataactatctgtagctttaacaatttcattctatccatctataaattcctctccagattcaatgtttctttgtttattatttcttttgttctaattaaaaataaagtgcaacaatatactgatatagccaagatttgtaatcgtacattgcctctttgaaaaaaacaaatgtatctactccaatcaggaataatataatttcaaaaccatgcacacatatattcatatcagcattttttgaaggaattcacaaatcactcccaaaagtgatatcaatgcacttatccgaatgttgaaagcaaaactttctaaaaatactctataataaactcaattactttcttaatcataattatcttcatatctcttatagttatttgtggcaaatctggccaaccatgtatcaggcggaagtgtccataaaatcaccaaaatccacactatgataccgatagccctgtaaacaccacaaagctccgtgcatggtgcaatatccagacacgcaaatacagaaaaaacaccacaaataataaatgcaataccaaaatacaccaaccaaaaattattctcccagcgattctcaaagaaaaacccttttatttttctccgctgtaatataagcaataccacaccggctatagtcatcgctatattagccgcttgataaacatatattcccaatataaatgcaagtagtatcgcagaaataaagactccgcatattcttgctccggctataccatcacttgacacttcatctttgatattactcatagcacctttaatctgtattataaaaaataccaaataaaacataagacctgctatcacaagtccaagccatttgggtaagccgaaaaccgcttctccgataaagcagcctattgccaaaacacataattgtatgaataaaacttttaaattattcttcatattcccccttaatttgtcactcctgtttgcaaccgttccagactcttcaactgttgttaatttctttatatcctataatccatatatcttcaaccataaatacatgaatgacacgaattcgtgcatgtttgacattcaatcaatattttttctcacaattaaaactgcctattaaaaaaataaacaacaccactataaatatcaaaatacacatccaattgcacatagccttttttgccatataaacaccatatatccctaatacaagttcaaaaacatatgcaatgaattctatgctatagaatactcatactgcgtatctccctttgatgctcaaaattgtataatattccataacaaaataatcctattaaccaaatagtaaaatgtataatgtactttctcataattatctccatattccccttgttttgtccggtaattttcaattagaaaataatctctattttttcattgaatgatgacgaataattactatgaatacagtaatcattccgcctgcataaatcttcataatccaatccggtataggaaaatacatattccccaaaattattattgcaaagataactaaaacttgacatattaaagccgacgcaataactattttttcttccttactcatattcatacatgtgtacctacctctctgcttgcaatctgtcctgactacaactgttgttaacttctttatatcctataatccatatatcttcaaccataaatacatgaatgacacaaattcgtgcatgtttgacattcaatcaatattttttgtttatatagaaacagtaccacttattctaaattgttttcaacaccttaagaatgagcggtactttttttgtaacgaatggtatttatttttttattgcaatacttacactaaactttccatcatctgcgcaaaaattataatttccttcacacagcctgacttcatctattatattacttaccccatatccatgtgataatctatcatcctttgatgtatatctccccaacttagatatatcaacttcccattcaataggattctctatcataatgaccacataatttctcacatttgatatattaatcataatttctttcttttttttctgtaatctattacatgcttcaactgcatttgaaatacaatttgaaagtattgtacaaattgttaaatcagaaatttcattcctgccactaaaatttcccatacaaataaacttaattaatggatttttttgattaaagtaatagataattgcatcaattattccgttatcataatatgattccaattttttacctatatcataatgcattttgatgtcatatatatacttaacagcttcatcatattgttctgtatctaacagattatacaatatatttatatgagcattcatatcatgttttattttccgtatttctcgcaaatgagaatacaattgactataatgttctttttgaataatcagatagttttgttttatcttattatctatctcaagctgcttcttatatgcacccaaaaacataaaaacaattccaaatattcctaacataacaaatgaaatcattgttaatacatttattacaattttaagtctatcctgaccaggtaaaattatatcatcggtcattacaattattcccatattgattatttctatcatggacgaagccataaaatatataggatcaatacgcgctatcatggacgatacttttttgaattgatttattattttgccaataagacaaattataataatagtaattatgtataccactaactcattattgctgccaactataattttaatcggatattctattacatcgatatatccatatgcaaacaaaaacactgctaatttacgccacatcgtttctttgaatagtatccctgtagcaattaaagcactcggaagcgctaatatggtataccatatgctttgtgtcggtcgaataaagataacgataatttcgcctaactgcattaacattatgagcataaacgcaaaatatttttttaacttgatatcaccaatctccagcttacatatcagccattcaaataatattaattctaaaatcatctatctgctctttcaacccttgccactttacacatataattaaaaaaatcttcttgtatttgttttttcattcttctactactctttagcttcaccccatctgtcataattatctcatctccaattgtattaacattttcaaaattaattataacactcctgcttattctggcaaaattcatatccttcaacatttcataaagctgtgatacacctttatctgtaataaaatattcgctcccatctaacatgtatatctttaagtaccttccctgtgcaataccatacactatatctgaaattttaaactttgtcagtccacttatagtatttagacaaatccattttacccttctattaataatatttatcgcatgaagcaatttcttttcaatttcttcttccctcacaggtttcttaataaaatctgtaacatttcgcccatatgctttactcattatttcatcatggctagtacagaaaataatcagtacctcattgtccgtctgttccaacatatcacggactttcagaccatctatgtgttccatctctatgtctagtatcaatatatcaggtttctcacaatccataacctgaattcctgactcatactggataattttaacttctatatcattttttaaagctatatttcttatactttccgatatttttattctacatgcttcttcatcatcacatattccaattctgtacattatcctgtattccttttctaaacttactctataataaataatatacaatctataattcatttgcaatcaaatctgcataaatgacataaattcgcacataaatgatatttcacgcatactttttatccataattaagcataattcctacatcggccattaaattctcaaaacacaacctaaattaatcttgtaaattcaaaatttataatttataatcttcatagcttaattgttttgataaggggattatttttatgaatattgctatttgtgatgatgaacaacaagatattgatatactttacaattactgcaaatcatgcaaattaccatacaatatttctactttcttgtctgcctctgacctgcttgaggcttttaaatcccaattttatgatttaatttttcttgatatagaaatggataagccaaatggttttgaaattggctctattttagcaggatattctcctcgtcccgtaatagtttttacgacaaacgcactgcagtatgcagtccgaggatatggaattgcttttcgatttttatgcaaaccgataacgattacaatgtttcaaagtgttgtcagggaggctcttgacgagattcttccgcaaaaggcagcggtaacgtgtggttcaactcagaaaatgatttctataaacgatgtcatatattttgagagtctgaaccggcacattatttttcattttgcaaatacatccacattggagataaaggattcaatggaaaatatgatttcatttttttcatatccttcatttgtacagattcacagaagttattgcatcaatttgaattatgtggacagctttacaccacttgctgtcactatgactgacggctgcaaaattccactttcgcggaaaaaacagaccattttccaagagcgctttaacaatttgatacgaggtaccatcaaatgaattttccaattgaagtatataccattattatagaatgcctgcttattttctacttctttcataaagaggttagacctgtatacccttcccgcagatatattatcctattttgcatatcactctttgcggtcataatgctatcaaccctatatacacctatgtttatacggcttgccattatcagcttatttttgtttttatgctatactttctgcttcaaatgcaaaatattccaaatcacctatactattatattattttttgtcacgtcgatgttttccgatgttattggtgcgtttgtactttccagacttggaatttcaataaatgaacttttaggaataagtgaaggacggcttatctacaatacaaccagcaagattattcatctgtttttgctggtcataattattttatttaccaatgcccgatttgattcaaaggctctactgcatgccataccactcatgctctgcaatctgtcaagcatatttattctgtttgcccagtacactacctttattgataatggtaaatactccacctttgtgatgaccaccatatgtatgcttgttatcaatatagtggtttgtggatatacggaaatagtaaagaaatcttatgaattacagaaaaatcagctctgtatgcaggagcagcttgccaaacaggagctttactatcaggatatcattgctcgtcaggacgaatcccgcgcactttggcatgatataaaaaaatacatgctggcaatggaaaatctggtttctacgaaaacacgacctgaagccgaaagccagctctctgccttaaagaaaaaattttcaagccttgaccaaatgattgataccggtaattccattgttgacggcatcctaaactatggctctaataaagcaggcagtctgggaatcaccataaactttaatctatggctggatactgaactcaacatttcgcctgttgacctgtacataatcattggaaacactatggataacgcaatagaagcctgcgatgcttttccggcaggtcacaaaccctccatctcatgtacgctgcgccagaaaaatcatgtgctgctttatgaaatatccaatcctattccacaggtttccgtaaaaaaagccggagatatccacggatatggacttgaaaatgtcaaagaatgtgtaaatagaaatagtggttttatctctgttaataccgaaaatgatatattttgtgtctctataacactaaacgtttaatatgtcttaaatccgcgatatcacaagccttccatcctgcacatcaaccctgaccttattagactctatccccgctgcctcaagcatctcatcggtgagttttatcctgtgcgccttgtccaaaaccgtatattccattgcagggtgtttcttcaatttctccgtacttacctttccgtcagatataagcactgtgcggtctacacggcctgcaagtgccatatcgtgtgtgactatgatgatggttataccaagctctttgttcagcttatgaaacagctcatagattgtatcagcagtccttgtatccacggctccggtgggctcatccgcaagcagtatgtccggcttatttgccagtgccaccgctatcgctgcgcgctgctgctctcctcccgatagctgagccggaagcttatccttatgctcctgtaatcccactgcatttaacagtttaagggcatagcttttattatcatccttgcgtttttttataatttctccgtgttttaaattatcggtattacctgaattttcaaacatcatcactgcctcgacattctgcagcacagtcaggtatgggaacagatttttggcacttttctgccacacaaaacccaccttgcccctgcggtatctcaccatttcagcttctgaatatgtggaaatgtcttttccgtcaatagtgagtactcccgctgtgggagtttccagtcctcctatcatatttaaaagggtggattttccgctgccggattttcctattaccgcaagcatctcccctgtttccaccgtcaggtcaagcccctccagtgccatcacctttttatcgtcggtctcatatatttttaccagtccatcgcagtttatcatctggttttccccccttttaatttaaattactatgccgtcactaagctcaaacacttcatcccccagctccatcaggttcggatcatgcgtggtcataactattgtgatgtcctcatcgtctatcaactcacggaacaatcgcatgacttcaaatccagcagcggtatcgagtgctcctgtcggctcatccgcaaagactaccttcgggcgatgaaccacagcacgcgctatcgcaactctctgctgctcacctcccgataactgatccggcatatgatccatgcgctttgagagtccgacacgctccagcagctctgatactctgtcatgcgtattctcatttatcacatcgttttttgcatctccaatgtcattatccatatcagtcaaattcttccgtatctgacgtttatttttcgcaagtctaagggcaaattccacattctcatatgccgtcatcgtgggaattagtgctatagactggaatacaaatcccatctcataccgccttagtatttcccggtctttctcggtcatctgctcgaggtttttatccagaaactgcacacttccctctgtcggcatatcaagcgcactaaggatattaagaagtgtggtctttccagagccggaacgcccttttaagatggcaagtgttcctttttttatctccatggatactccgtcaagtgcgtggactgttgtaccatctcccgccttgaaatatctttttatattttgagcaattatcgcattttccatatgtcacgacctcattttttacatgctaactatcttctccaagccttagtgcctgtgctatcttcatactcttaagcagtctgctgataaccacatagcatacggctacagccacgaaaagtactcctgcaagctccagcatatcagattgataaatatatacatttactccgatattgtgtttctgcggcagatatatgatcgatatgagccttacaaacatcgccgttgcagttatacctatgcctgctcccgcaagaagcggcagaaatgataaaaatatctgctcgtttaaaagcattgcttttacctctctcattctcattcccattgcgcggtatataccaaactgcagttccctctgttttagtgtcataacccaatacagcaaaaatcctactgagcacactatcagtgaaagtataaaacttaatgtaaacataccgtttgtgatctgcactgtggctgagtttttattctcgtctataagctgctgcgcggatgttaaatttttgtatatatcatccaccgtttttccttttgacaggttcatccacacactgtacggtgtcatgccgaacttttccacaaccgtagcataatttgcaacgatcaggtatttctcctgctcggtcacatttccttctgcatctgtctcataggtgtaacgctcgtagcccggaaaaccttttactatggcacatacctttgcattctcggatgcgtagatctgatcttcatcgacagcctccggtacataccttgagtaatttaagctgtcaccaactttaagtcccagatcttttgccagatttgaggaaatgatgactccgtccggctcttttgccagctcattcaggtaattgaaccagtgcgcgtcattaatatcatcattttggtcactctgcaatttcgcagtctcaccgaattcttttgtgtttatcgccataagatatgcatccgaaatcgaaccactgcctgcggaaatgtctacccgctcgtcctcaagcacacgcgtgaccccgtcacagatgccctcatttttgagcgactcgtatttaccaaaatcaggctcgtcatacatccagcttacagagccatctttattcttctgtatcctgagtctgaaatcttcgttgtatatcgcatcacaacccacattgtagacgatccgtttttccatattgctgttcatggtgcgcgccatattcgcgtcaaaaataccgccagccactgtcatgataagaaatactgccagaaatccctgattatatctggttcgtttcagctgtaaaaatgatgcatacattgccggagaaaaatgctttttaaagagcctgtccacaagcagaataataagtccggtaagtcttacgcacaaaagtgccgctgcaaatataaaaagcgaattgtccagtatcatgacaggatctatgctcctgttctcaagaacagatatcgcaagcgtactcttctgcttgttgtaattgtaaagcagatatgctgacagagccaaaagtataacgtctataaagcatttctcccaaagtggctttttctttgatattcgttccctgctgcgctctgatatggcatcctttgattttttccacaccggaactgtgataaacagcaccatgataactgccgctgccaccgcatagacaagcatctgccatacaaatctgtaagtgcctatatcctttgccgtaaatcttaaaaatccgtctgtagatgcggcagcccggcacattatatatccgagtactattccaagtacacagcccgcaaacgctattattcccgactgctgtaggtacaaaataaatacctgtaattttgtcgcaccgcggcttcttaaaacaagtatgtcattttcctcgagcgaaagtatctgtgcagatatcattcttataaataaaatcaaaagcacaagacacggcagctccaacgcccaaagcatcagctttatcgtcttctgctgtgtaaaaaagcgctccagcgtatcacggatgttgtcattgtagagcttgtcagcatccttaaactgctccatataaccgtcataaagtgaggcattttccgtgttgatctgcctgtaatccagcatgaggaaatcactgtagctgatattgtcctcgctgtaatactgcatcatttcgtcaaaaacatcctgcgaaacaaatatcacatcgcccatatccgaaagcgtcttggcccaatatggattatttatatctttttcactacagatctgtgatattacgaaagaaatttcctttttcccactgccatcaggtacatgtaaatagattttttcacctgctacaagtccgtagtgatccattgtcttttcgcttatactgcattcgaatgtggctgtgtcagtctgagattttacaacatccacgtactccgaaagccccggcagatatcctattgtaaaataatggttaagtcctccaaactctgtatctgcgcgtcctcctgagagtgtgataagctgctgtgaggaaaccttgtttatatccacatattcagtccacttcttttcgtatcctgacagcttatcaagcactgactgcgaatcaggataatctgccaccgcatatgttccctcgcggctcatctgtgcaggaaactcattctgctgtgtggcatgatccgtaaaaagtctgtcgagtatctgatttcccgcacccttttcaaacatagggtggcacacaaaaagtgctataaacaaagccactcccataagcagacacagatttaaccattttctgttttttaatttattaattacgaagccaaacatatttcatcgccctcatcaataccgtaaagcacaagtgtattgctgcctgatgtataatcgctcaatattaccggctgctttaccacgctgtccccatcaattttccacacatagtatgatatatcatctttgtccataggattgacctgcttgtgtatgatcgaagtcggcaccactaccacctttttaaaagaaacataagaaaactttacagcagatgccctggtcagatcatccggtattccattgtcaagttttatataaaatgctgcatttccatatcccgaatctgtgtttccggtaatatgcacacctttatcatcctgatttacatatcccttttgagcttccctgccataaccggcaaaaccgatacagcttccgtagatcgttgtaccgtccagctcaagtgatacgcgctctcccacatctgctatattgtccttatatactttatagctattgctatcctttacctgaaccagcagtacgtccgtggaatttccggttatctgcaggatatctgagccttcctccacattatctcctgccttgacactcacctttgaaacttttccatcatttttggcatatactgaaatatttcctttgccgtcatttcctgcgcttatgctgtcatatgctgactgtagctgggaaagctgataggtgtggtctgcacaggcaagttttttctgcagattcaataattgtaaattcagtttcaactgctgctcatcatatgctgtatccggcttttcatcctgccggttattttcttctgcgctgctaccaccttcagataaatcttttatctgtttatcgtaatcagcaatcttctgcgcataggattcattctccgagtcgatcgcatttttcgcctctgttatggcagctttgccctctccggtatccaccacgtaaagcagcatgcccttttctaccgtatcgtcctgcttcacattgaccgatacgatctgcccttcataatcacaggtttcggttatcgtccctgcgtcagatctgctgtagcgcacaccgtagtttgctatatcaaagtcagaccttgttaccgtatatttgctatactttgtcggaacctgatctgtagaattatagtaaaccagctccccctcttttaagccctctgtgacctgtgtatagttttcatcagactcacctgttgttatgatgcgtttctcgcggccgccctcatcatttttcacatagacatatctggtatcgccatccttatagatggaatcttttcccacgacaagtgcctgatttgcttttgtcttttcaaaatataccggatacatctgtcctgccgtaagaaacggcttttccctgctttccacgcacacatccggatagcggttgtttatcttcgaaagtaccaaaacctctgatgtatattgagactcggtgacatcatatttttcgccatcgactatcacatatttcttgtcataatcgctgtatttgtactcatttatggctgtatcttttatatccagcacaaggtcatccgtatcggagacaatgactatattctcgtatgccgcagcagaccttccatctgtcagcttcttagtgtaagtgacaagaccgctgtgggctgccttaagcgttccatcatcaacaatctgctgatataaagccatctgttcattgatcttttgcactcggtattcgtgaagctgcttatcgtaccgttcattttcctgttctgtggcaatctgcgtattgtaatcctcttctgtgctctcttttttctcaatctgttctgttgaaaattcgtccgtatccgcagcctgactctcccataatttgatctgcgtatccgagatctgagcggatatctcatatgtctcattctcatgcgccagcgcatcattacattcctgcaactgtttttttgcctcatccacatcacagacagcaagcacatcccctacatttactgtatctcccggctccacatatatctgtgaaatgtttacgttggcactgtagtaattgcagtaatccctaggaactgcggtagccatcagcacctgtatggagccaatcgtaccgtattccacaggtctgtaggcttcatttaacgctacaggttcttcaagctctggtatactgctttctgtcatttttccacagccgcctgccacaaacgatacacatatccccagtactgccagtttttttattgataaaatgtttctgatcttcactgcaaaaccacctcatccccgcttttaagtccttctgtgatgatccggtagtctcccacctgatctccgacacttatccataccgcctgtctgtatccattctcatccagtgtgtatacaaaatacctgccatccttctcatgtactgcgtccttttgcacatacacagcattttctatagcagggcgcgtcacttccatggaaaatatctgtgcatccgatactgccgacatgtccgataccggttcaaaaacaacctttttatcgtccacctcttttaccttaagttcaaactctatatcagatgctgttgccgtgtatacatcacctacattaaagtcataaccttccggtctgtcagcttcgtaattgccgtttccgctgatttctgttataagattgctgcccggttcaaaaactcccgccaaaagtgaattgtccattgctgtgatcgtaccatcctctgatgccgtgatctgatatctcgacagtttttccttagcctcatcaagataaagctgcgcaacctctgtatccttatcaagctgggctatatcgcttgaataatcctgagtatcatcgattttcataatagccctgtagtgctctgccagaagcttattctgactgatctgcccgctgtagtcctcaatctttttctgtatctccccggatttaaaagccaccagtatatcgccctttttcacatgatcacccactgccacatttaccttttcaagcgtaagctccgtgtttgtcgcaccataggaaaacctggtatagccctgcgcgctcagactgatggtagtctgcggtgtgagtgaaccgctctgtaccgtaactgtctggtatgatattttctcgtaggaagctctgtccgtctgtgcaagctccttttgtgccgccccacatcctgaaaataaaatagaggtaattgcagcggcaagtgtcaaacgccctatatattttttctttttattaatcatatattttccacatcttttccaaataaatatgaacctgatctattatctaaaaatgtaactccatgtataaactttttgtatcatgtattgcattttttattatataatttcccttagtctccatgcacacttctctctgattcagaatatctgctccggctcaatcactgttccgtctattgcatttacaaataccggacacgattcgacctctcctctttgcagcagctcaaggctccatgccgggatatagctgaatctctgtgaatctgagctgtcctttaccctgatatagccaagtgtcagataacgatattgtgtatccgcttccacaatatatttatccgggtggctttcaagctcatttcttgcaatcttataaatatttgacaccggtaagagctccaccttctgctgttttttcacaatgcttaccggctctgctatatcaaatctatagacaccatattcatttacattgaaactgcctgtctcataaccaggacagtccataggacaaaatttgttataagctgaataatcaaatacattcagtgattttgaatacactacatcatctgcgccaagcgaatattcaagcgcatagccccatatggctctatgcacatccccctccttatatacattatcctcagtcttgttatatccctcccattcacagtcgctttctcctgttttaatcattgactcaattcctattgcctgcatgaagtcacctgctttcttctttgcctcatcaaacgaaatatttgcctcattgacatcgcttaccggcaggtctccatcaataaagtcaccgtttaaatacctcaccgtgtcatactctttcagtgattttggtccatagtactgcttcacatagccatcatcaaatttagtactcctctcatccggatccccatctgaaacgcttttcacacatctgtcaagcggatagctctggatgcctgatagcacactgttgtcatcatctggccttgaaaactgaaggtgaaaccaggtatcacctatttttccgacaaaatcatcacaggaatcatattctgtggcctctgtccacacatcagctgccgtttcaagtgcttttgtgcactcagttttcatatcatcatgccatttcaaaatctcctcagaggcatcatccgacagactgttgttgtccctgtcaagagtctcaataatctcctcaagctccttttttgtcatgtgcgcatagtcgtaataatagacctgtgaatcaccaaaatatgcctttatcaccttttccttgaactccttggtacaaggtatgcgctctacctctgtgactgacatggtatcacattccggcactctgatatctgccgtgattttcaccttttcatcagtaccacccatatttactgtaagttcatcattaaaacttgtattggtgtcaatatcctttacactgcttaccacattttgggattttacctccgtgtccacgccataatctacctttttgccggcacagcctgcgagtgatatgaggacaagtgcctcgatgagtgtcataattgcttttttcttctttcccataatagttctccataaattttaaaatacatcctcggaattgattattgtgccatctattgcatttacaagtatcacatttttcttttgtgaatcaaccagccgcgaaaatgaccatacaggcacataactgtattttgcagtttcattcttatctttcagcctgaaatatgtaagctgcatattgttaaagcttttgtttatctcaagctcatatttgtcggcattgttttttagctgctccttaattatctgctctatattctttaaagaaagcatctccacactgccggatatgcttgtcacactcaccggatattctataaccacatcaattattccattgtctgtaacagttagctgaatactgtcacccaatgtaatgtctttcgtatcctcgcgaagcatagagtcacattctgatgaatcaaaactatccttaaaaacctgtccatcaatgcctgttccatacgaatacacatatccccacaatgtgttactgcggctctcccagttttcatccccattattaaatcccagccagttacaatcgcactctccacgctcaacctgatttgacagtccaagctttcccataaagtcctgcacaagtttttttgactctgctgcacttcttgtacattcatttccatcagctccggcactgtctgtcagattatcctcctgaaatgtctgcgagacattatcataattttcctccttaaatgaaggtggtccgtaatattttccatcgagcttaaagacataagcatttacccaatgctctttaaatgttacctcacaaaatgtatctcctttatagccggcatactcatcacagctttgtaaatcagaagcaattgtatacgagattttcgcatcagtcagtaaatcccgataacctgataaatcctgctccatttgctgtaccagctcctgttttgtactatcatccacatcatccctgctattcatttcattcagctccctggattttaaatctatataagaattcaattcatcaactgtataatgctctaaatcatgataataatactctccaccaccaaagtacgcatctaaaaaccttttcttgtactctgtatcgagcttcacatcctccactccaacaacatgcatggtttcacaatccggcaccagtattttggcatcgattcccagggttacatctcctttttttgtctggacagttatattttcgacccatggcttgtcagtccttaaatcagataccttagaagcgttcttttgctcctttacctccgtgtccacaccataatccacctttttaccggcacagcctgtgaatgatgtgaggacaagtgcctcgatgagtgtcataattgctgcaaataatctcatatttcgtgaagacatgttaccccttttatccatatgtagctctcctccctttttttctttcccggtgactattcagaatagttatcttccatgttgttataatgagtatatatgtcagttgtaaactttttgtatcatacattgctttttttattataaaaaaccggtctgcacatacttatgcaaaccgggtctatatcacttctcatgaatcgcatacaaatattcattttcctgtaaaaactgcagcacctcatagctttcattatttttttgctccactgctgttgtctcggatatcaggttaagctttgaaaaatctatcccgctgtagtcaaaatatcctttgtaagcagacaaatcattttctgcctgtgattcatcatctgcctgcaaaacctctttatattcactcatatcactaatatccttcatatgtgcttttgccataatgattgtcccatcctcaagcatccagattgtatgattttgtgtaccatcatacttctcaaacctgattatccagtaatatgccgtatatgtgttaaaagtattatccgatgcctttttcgctgctgcctcccacgtataccagttagagtagtcaggtgaaagatttacaggatagagcttttcgtcataaagcttttctatgctttttctgcatgtggcaactgcctgataatcctgctcatccatctcataagaggcagcatcatctgtcgtgctgtcccactgcccatctatgagcgagagcttctccgacaatttcagattggcagatgcttcctttgccattacagagcctgaaggcagatagcttttaggaaccttcgccacatgatcatgttcacttttctggtttgcctcaagcactatgccaggcaccatgatgcctgctattactatacagattactgcaacagacattattattaatttgaagctgtcttttttcatatcttcctttaaattttacgaatttaccattttttatatctatattgcgttcagattaccacggaagcaaaatcctcatcgttgttccgcatccgggttcactttccactgaaagtactgcattatggtgctctaaaatgattgccacaagcgacattccgattccggcaccgccctcttttctggctctggatttgtctgccatataaaactcatcacaaattctttctgcctgttccttagtcattccgattccgtgatcgattatgcatatttcatatgccctcgtgcatttcctgtcatctgctgattcggcttcgcctatatccgttttatctttaggtatattacaagccatattgtccacaaattttcctgtaacctcaacctgctgaccttcttctgacgctttccttgcattatccatcagattgacaagtgctgtaaccaaaagctctctattcacggtcagcacagtatcctctatctctgtttctatagtaagatgcctgttttcgtatgcaggctcaacaacctttaccacctctgcacaaagatctgccatatgaacccgcgctttttcaatatcatgccggcgaagatatatcagctcaaaaagcttctgcgacatgctctccagacgttttccctccgaaaagatatatccaagcgccatcatctgctcctctctcggaagctccagtgaacgcatcgtgtctgcatatccaatgattgacgtcataggggtttttatctcgtgtgtaaaatccgctacaaactgctcacgcctgtgcaccatatcgttaagctcgtctacatgatccgatactgcctgcgccatgatattaaatttctgcgcaagaagccctatctcatcatgactttttacgtttacccttgtggcataatccccctgcgctatttcctcgctgacgtggttaagcttctcgagcggcttagtcatgtatctgctgataaaatacattgctgccgactctgcaatcaatatgactattattatcagcctgaaatagtttatctgctcatcaagcagtgtatacgcctctgatgcatcgcatttacttactatccagagatttttttcatctatcacactctgcgatgtaacatagatatagtgcttttgggattcttctttaatcacatagtttttgtttcctgttgtgagatttttaaaaagtgtatcacttatccttgcatcacttttgtcatctgtatatactttttcaccatcaaaatatatgtagaaaaatgaatcccttgagcgcacactgctgcttacacggcttccgatctgcggaagttgcgcggctattgatgatgcggaaatgctgctcttttctgcattattgttatctgtattattgttcgaagtttcagaattatcggaaactgaatttaaaagctgcaaaagctcatactccacagaggactgtaccagattattctgcacaatagcgtttttaagctgtgtctgcttcgccagctcaaaattcttgtgtatcatgaggtatcccaccagccccagtccaagtgaaagcagtattaagtttgtgaacaataccttgtacctgaatttcatttatccctctttttgtatattacgcttacccatatttaatggtctttagttttctattcttccagcctgtatcctgccttaaatacggttttaaggctgtctcctatatcaagctttttgcgcagtctctgtatgtgaagatcgagagtcctcgactcgacagagtactcacttccccatatttcttcatatattttttctctgaaaagtgtgatatttttattgcgcatcaaaagctcaagcagctcaaattcctttggtgtaagctctatatgctttcctgcctttgatacattctggtttttcgtatcgatagctatatccttaaaggtaagctgctgctccatcttattataacgtcttagcactatatttaccctggctaaaagctcaacaatctcaaatggctttaccatatagtcctcggcaccggatgtgagacctcttagcctgtcatctaaagtggcttttgctgtgagaaatatcacaggtatgccaagcggctttatgtattccataagctcaaagccgtttaactttggcagcattacatcaagtattatcaggtcaaaatttctctcctccagaatatccgctgcctccataccatcaaaggcacaggtgcagctatagcctgctttcatgagatttaatctgataaggtctgatatcggtttttcgtcttctactattagtatttctatcatcatattccttctaaaactttattatccgtaactattatcctttataaatctttgcatattcttcttttgctgtcaatcctaaggagcatatatttagactgcattatgcctagctatttatatattaacagctacttgtatctaaaatgtatcagacgcaagcaattacatacgaaaaatccgccatgcatacactgcatgacggattactctttaatcatatgctgctcctttaacctatcttccaccttaaaaatcacaattatctacacaaccctggtaagcagggttttcatctctgcgctcctgttttataactctttataacttttaataatttttataactctttataactttgtaatctttttataactctttataacttatttgtcaaggtcttgtcccatacgcaccctacagtccaatatgttcccctacagcctcctgtagttctcaagaagcttgtgcagatcatcaatctctccaataagcctctttcctatatcggtatccttcacaagcatacgtctcttgtcattttcctcgacctctgatgatgtctctatgtcagtattatttatcagggcatcctccaccgatgtaaaaggcgtgtgtgccttgagccttagaccatgtgaattgtaaatcagtgtatagccggcgataccggttttcttgttcatcgcacggcagaagcctccatctatcacaaacagcttgccattggccctgacagggttctctccctctattgcgtgaaccggtgtatgtccatttatgatatgcgcatcatcatcatacagcccgaactcatgcagtatctgacagcagaagctcttatcgtaatacctgctgtagtatgggttagaaggctcttcccacatgctcttgtctgtaacatattccatctcaaaggtcttaagccttctgccgcacagcggtgatttttctcctccccacaaaaaccacataaagtccacatcatccttataaggattgtccacatacgcagcccttgccttctcatcacatttatcaagcagcgcccttccgtgataaaattcaccatcaatatacagcttatcaaaggctccgttgctatcaaccggaacacagccatgatagagcaggttgccattgtatacattgtacatgccgcccttatcatacaaaaatctgacatgcttgtgcaggcgctgtcctgtcacaaactgtctgtgcagctttctcatgatgacagtctcctcgtcacttagtgtgtagggtctctcatcatcaacggttggaaagcgctttctgtccactcctacatcctgcaactcgtccagcctgtcaagcatcagcctgtttcccatctcatactcgggatgtgcaagtataagctgcccctcaagcttaaaaagcattactgtgatggccgcccttgcagcctcaattccatcctctataccatatgttttcatgccaaacagcattagctgtcgtaagcttattccgtaggcattctcaagaatttccacattgttgtatttcagattgttgcggatgacattacatatacatgcatcatttccacatgccgcacccatccagagaatgtcgtgattgccccactcgatatcaagcgagtgataatcataaagcagatcgagaatcttatccgcgcttcctcctctgtcaaatacatctcccacaatatgcagatggtcaacagcaagcctcttaatcagtgcagacaaagcgattataaactcatccgcatcctccaaatcaattatagtctttaatatctgcttgtgatatctgacctggtttgcatcctcatcctcctgcgcatgcaaaagctcatcgatgatgtacgcatattcctcaggcagagcctttctgaccttcgacctggtgtactttgatgagagcagctttgcgacaagtataagctgatttaacgtcatagcataccagtcactgtctatcttgccctgttcatcaagcagggccattttctctcttggatagtatatgagcgtgcaaagctcctgtctgtcataatcagaaatcgtatccttgaaaatcaaatccaccttttcctttatcacacctgagcagttgttcatgatatgtaaaaaagcctcatactcgccatgtatatcactcaggaaaaactccgtgccctttggcaggtttataatcgcagaaagattgactatctccctgattacatcctgacttgatgaataattttgttttaacagcttcagatactttgtattgcctttatcgttgtacatatttcccccgtaacctcttatttttcaatgaaatatattaattcgctcctattcatgttccatgctataccggataaatcccttaaattacatttttttcattatataataatttttttcacctcgcaaccaaccctgtcgtttgtactaaaaaagatgcgcaaaactaatactattttacgcatctttgacatattttatattctgaataattacctttatttcatgtactcaggtgtcacattcctgcccatgccctcaagcatttccttgtcactcctgattgtggcacaagctactgtcgtaagcatgtttcctgtgattgtagctgatgctcccgacttgaatgcaagctccccatcatttgtaagcagcgcccttccggcgccgagacgtatgtctgcctctggatttatatatctgaaaaatgatactgtacgcagtatatcaggctcactgatatgctcaagtccctcaagcggcgtaccagcaatcggcataagcgcattaagcggaatggaatccactcctacctctgcaagactgactgccatatccagcctgtcctcccaggtctcacccattccgatgatgccgcctgagcacgcatacatgccctctgccttcacctttttaagcgtctcaatcttcatatcataggtgtgtgtggtacatatattggggaaattacgctttgaggtctctatattgtggtgatagctgctgacacctgcctcgtgcagtctgtgaagctgctctgctgaaagaaagcccattgatgcacataaatcaatcttgcactctctgttcattgtctcatatgcatgtattgccttgtcaaattcctcacctgtcagcgcttttcccgctgtaactatcgagaaacggtctacaccctctctctcattcatcctgcaagcctcaagtatcttttcctcaggtaaaaaatcataaacctcacaatttgtatgattatgtgctgactgcgcacagtatttgcagtcctcagggcattttccgcttcttccgtttattatcgagcacaaatctaccttgtcgccgataaacttctccctgatcatatctgcgcccttacacagctcgtctaaatcacatgtaaggaaaaatgataggtcatcatcccttgtgattcttcttccgtctattatctcctgtgccagtgttattggatccattttaatctccttcgtgtcctgtatttcttctctcatttaataagtatcattataatacatatcatccgttataattgtcaactataattttttcttcggttaacaatgataataaaaaaacagaaaaacgtcaagatgtttttatatatttaaaccagcataatcaatgttcctgctatgatgagcaccagtcctgtaaaggatttaatcgtcagtttttccttaaatacgaaatatgaaaacacgattgacacaactatgctcagcttatctataggcactacgacactcgcaagtccgtcctgcagtgccttgtaatagcaaagccatgagccgcctgttgcaagtcccgaaaggcagataaagccaagctcttttttctctatatgctttatggtgtgctgttttcctgtggcaaataccactatccaagccatgataagcaccactatcgtccttattgcagttcccagattagaattgattccctctatgccgacctttcccagtattgaggtgaagctggcaaaaacagcagacagcactgcataaaacagccatccatgagaacccccggccttattctgctcttcctgtgatatctcccttttggtgatcatcatatacgttccaattgctataagcaccacacataccagcctgagtacgtttatctcctctttaaaaaagataaatgcaagtataatggtcagtattgtgcttgatttatcaatcggcaccactctgtttacatcgccaagctggagtgctttaaaataacaaagccatgaggctccggtagcgactcctgaaagcatcagaaatatccatgtctttgctgacacagctgtaatctgcccctgcgctttaaccacaaataccataatccacgaaaaaatcaaaactacaattgtcctgattgcagttgctacgtttgaatcagtttttttgataccacactttgccagtattgatgttatacccgcaaaaaatgcggatccaaatgcatataatacccacatttttttctctgtctacgcttcggtcaactacgttgtccggagttcgaaacctccattcttctaaatacaaaaaaaccgttcaaggaacggcttcttttacgctaatgagacatcggggattcgaaccccggacaacttgattaaaagtcaagtgctctaccacctgagctaatatcccatatattcagattgtaacagggctagttggattcgaaccaacgaatgcaggaatcaaaatcctgtgccttaccgcttggcgatagcccttgagtaatactcgtgcgccgcacggatacgcatataatgcgcacgacactatttgcactaatgcaaagggtggatacagggattcgaaccctgggcctccagagccacaatctggcgcgctaaccaactgcgctatacccaccatatttacttcatatggtccatatggaattgatatgaaataaaaaatgtgcctgaagggattcgaacccccgacacccggcttagaaggccggtgctctatccaactgagctacagacacatatgggatactgcgaatactgcaatatctaagcgggtgatgggaatcgaacccacgtatccagcttggaaggctggtgttctaccattgaactacacccgcatgtagtcggggtgacaggattcgaacctgcgacctcctggtcccaaaccaggcgctctagccaagctgagccacaccccgaaggatttgtttgcgttctttccgtgacgcaagaattagtatatagcaaagggcagaatatgtcaacaactttttttattttttttatattttttttaaagtggctgccggacagcttaaaagagcttcccggcaggcattttatccgtatacgttgcaattcaacgcctatactctagatcaccttcacaagcatctctctcatggcgcgaagagccttgcctcgatggcttatggcattcttctgctggggagtaagctctgcagaagagcagccgtactcatctaaatagaagataggatcataaccaaagccgttggctcccgctatctcccatcctatgtagccctccatagtctgtctggtcacaagttcctttccatccggcagcactgcggcgatagcgcacacaaagcgggctgtacgcttctcctttggcacaccgtcaaggcgttctataaggttattattctttatatcataggaagtatcctcgcccatatagcgcgctgaatatactcccggttccttattcagatagtcaatctcaagtcctgagtcatctgcgagaacaattgcatctgtgtgtgccgctattgcgcgtgccttaatcagcgcattgtcttcaaaggtcttcccatcctccactatatccacattgatacctgcttccttcattgaacggatatccacgtcacagtctgaaagtatctctttgatttctctgagcttatccttgtttcctgttgcaaatatgatttttgtcataatatatttccttccttctttttctattcggacaatttccagatacagctagtagccctcatcaaaggcctgcatgattgcattgtatataccctgcgctgcctgtttctgatagtctgcattggccagattgtcaagctcctgtctgttggtcatgaagcccacctccacaagtgcaaccggagcctcacttgttcttattatatatatgtcatctgcaggaagcagcccaaatgccctgtttcctgtcgcagctgtcacgttatccatgcaaatctgtgcaagatgtttacttccgagctctctgttatctgactggctgtagagcacctgcgtacccgaaactgcggtgaaattgcccttttcatatgagttgcaatgcacgcttataaataaatccgcatccgccttattggcaagtgccgctctctgctgcagtgtaggattggtatctgttgtcctggtgtagaatatcccaagccttttgtcacctgaatagctgtcaagctgttccttaagtgccagcactatgtccagattgatgcttttttcctctattccgtttcgcacggcaccggtcatacggccgccgtgacctgcatctattatgatgaccttatcgtatatatcatgcagattgacaaagctcagataaagatatccattctctatgcgctgcttcacctgatagagcttgtctgtagtgatagctatcacaccatctgccccattgcggtaatactgcatggagtctatatgatttgacctgcctgtcatggaatacttcgtaaagtaattgtccacatcagccttaagctttacatagaccgtctgcgtcagggcatcggtttccaccgatatactctggcgctccccttctgagtcgtccggcaactctatccttaaatcatcctcaaagccggctttctcctgcaatatctcatcagggttcttctcctgctttgcatctgtggaagccttgacatagttttgcagcacattatcctccagtgcttttgccatatcatacttctcatttatagccggaagcttttcaagcgtgaccggcacgataagtgcaagcataacgaaaaatactgttattatctttagaatatttctgtacatatcatctgttatcagaaaaggcctttatacagaggttacaatcctgtttttcctttacattgatatatgccacaccatcatagctgatgtagccctcgccatcatccagattgactgtagacatgtatgcttctcccgagttgtactctatagccatcggatgagtcgagcccggtgtatttatataaagtacaatggcataacgctcaccggactccaaatcaacaggctcatcaaaatcaacagtgtaatagcctgcattttttagtgacccctcagccaccagcgtcttatttttaaaagaatactcattctcaaaattcttaactacatacagcttgtatgaggtatccgctgctgtagcataaaagccggaagcccttagtgattcagccgactgtgcggtaaatatgttggctccgtacatatcctccttgtcgtagcccatctttcctacccagccacacaggtcactctggtatatattatcataattgtcagcactctctatatctgtataaacaacattgtgcgtacccacatttgtatcgtagtatgacacatagaacaccccattgtctccaaaactgctgccccagctgttctggcatataaaggctccatctccttccagatccacattgaagttttccttagggtaattgtcatcccagccaattataacaacatcatgatttggcttatcctgacccatataacagtaagaattagtctgcttattgtaataaggcgtctttgtctttgagcttgctattgtactgtaaagcgatgtctgcacaccaccatatttgaaaacagcctcctttatgccctgatagtcctttccatctatgataagcatctgctgcacatgctttactgcagcaagatcatcgcgtgtcactccatctccgtaaggatcatccgcgtcataaaccggtccctgccatgctgccagatatgccattcccatggtatactctccaccgtcatactgattgacgttgaaggaattgctcatactcatatgatccacggaaaacaaaagctgttcctccggcataagggctgactcgagtgcacttgttgccgcaaaagcccaacaggtgccgtagctgccctgatccctgattagtgacacacgctgtctttccctcagatcatactttgttggcaccgttgatacaccctcggatttgtctgtcatagtgagtgtatttgtcgccgtatcaaagctgcaggtcatatccaaaagtttagacagcttgtctaagcttgcataaaactttcccttatactgtacaaagccattgtcgtctgccagcttgaaatcagctgtcagactgtgcttttccaccagaagctcatttttattgtatacatgtgcactgctgtttagtgcatcgcgaagcatagacacgggaaccattatattcctgttctcatccatatacacatgctcatcctcgctcgtatactccttattttctatcctaagcctgatggtggtgccatttacatcagcagccacaagcggactccatatagtattatctatctgtgctcctctgaacgcgccaagtgtagagctgtcctttgcatatatgtaaaaattagacacaaagataagtgccaagatgaatgtaaatgcaatatatctctttgaatatttcatataccctgctaatcctttttccttctcggaggcttaggccccataaactgataaaaatatgtctttatcataccattgtagattttcctgtttttgtcagcttttctgccgatatagcgctctgtatcctcatagctcgtaatcagatacatcgaccatgcatcaagcctcttataagcttctccaatctgtgaatacagtgccgggagcgctgatttctcctcgagtcgctcaccgtatggaggatttgagataataaatccgtacttcttcgggtgatgcaggtcagccacagccctctgctggaaatgaatcatgtgctccactccggctctcttggcattttccctggctgcagccaccacatcagggtcaatgtcatagccctggatgtccacctgcacatccttatctatcatatcctctgcctcctgcacagcctcataccacagctttcttggtatgatattggtccagctctcagctgtaaactccctgttcataccgggtgctatgtttgctgccatcatggctgcctctatcggaaatgtaccactgccgcaaaacggatccacaagtattctgtctgcatgccatggtgtaagcatgatgagtgatgctgcaagtgtctcagtcagcggcgccttgctcgttgccagacggtatcctctcttgtgaagggaatctcccgatgtatcaagtgtcaccatcacctcatccttgtacagaaaaacccttaccggatactgtgctccgtcctccgggaaccagtcaatgtgataagacctcttcattctctcaaccatagcctttttcacgatagactgtatatcagatggtgaaaaaagcttactctttatggaagaagcctttttcacccagaatctgccgtccttgggaatataattttcccatgggagagcctttacattttcaaaaagctcatcaaatgtggcagccttaaagcgtcctacctgaagtaatactctctctgcgcctcttaagaatatattcgctctgcatatagcctcagcatcgccctcaaacgataccctgccgtcctccacacgtgttatctcatatcccagatcatatatctccctcttgactactgcctcaaggccaaaatgacatggcacaacaagctcaaatctattcatatattgtgtaactgcctttctataattgtactttacattgttatctaatattgttgcataaatttcaatttttttaaatagtttcagccatatttctgcaactttttttgatatccgcacatagcattgtatccacctatgactgtcgctgtatcaaaaccgcgatttcccagatatctggccagcttcatgctgcttccaccatgcgtgcagtaaaaaatcacactctgtgacacatcgagttcactctcatatgaatccgtgatatccataggcatgctgagtgcgcctttccagtgcgacctgtcgtattcctctcttgttcttatatctataagcagtgcattcatctctttttgcaccttataaagctcatccgcataaactattttaaatttcatacatccatacgccaaaatacgaatttacattatgatattcattttattatgagatgtgaactgcgataaatcaccaaaatcattacagccggtgctttagcactttagctctttaataaattaactcgttttgttaaaattatattattttgtgtttcaaagtattgctttttaattactgttattttataatgtttccgaagagagaaatcttttcaatgttatacctcttattaattatttatactcccctcaaaagagccggtcacatgaccggctcttttatactgcttatattttttatatttatcaatccaaaagcatctcatactctgttaacggcagtggctttgaataataaaagccctgtatactgtcgcagtctatattcttcaaaaactctacctgctcctgactctcaacaccctcggcggtcacgcagattcccagctccttggccagtgctatcgtgtgcacaagcagcctctcaccatttgaatctcctatatagtcaatcaggctcttgtcgattttgagtgtatcaaagcacttcatattgagggtaacaagtgatgaatagcctgagccaaaatcatccaccaaaagtggaaatccattgccatggaatttatccgcaatactcttgatttcatcattatcgaccgctgcactctctgtaatctctataggcacaagatgtgtgtatatgccgattcttcttgctatatcatgatatcttttaaccacagactcaaagtacaggctcgctctggacaggttgattgagataggaactatttttttcccttcatcaagccatcttctctgatgtgtacacacctcgcggaatacatactcatcaagcgccttaatcatgccgtttctttcaaaaagcggtataaatttggatggcggaataatctcattattttctcttctccacctgacaagtccctctgcaccgaccagcatgttggtctttggagcatacttgggctgataccatatctcaaaatgattgtcatttaaatccctgtagaagttatcctccatctgcttttcttcgacaatcctttctgtatcggcctgactgtatatctgatagagcacgtccttccgctccttgatccgattcttggcaaagttggcctcgccgtatgcttcctcaacctttttgcccggctcccattttgtcacaccaaagtatggctgaatctttggaatctttaaggattctgaaaccttaataagctgtaaattgatggtctctatctttctgataaccttatttatcttgtcatccgcaaagaaaataacaaatctgtctgcatttatatgacctgatatgtcattatatcctacaacaccgcgtatattttcagaaatccatctaagcgcctcatcgccctttgccacaccacagatggagttcactatcttgaaggagtgaatatccatggaaatcagatatcctgatacgtttctgtcacgcagcttctttttaaaactctcgtaattgttgcctccggtcactgcatccacatacgctatacgctcaagctctctttgcttctccgggcttatatccgaaaagcccgctatcatcttgtgcagctctcccacgccagacacattgacaaactttgctctgcaatactgtacctgtccatccctcacgatgcggtaatcatgctgataggtatcctttatcaaaaactgcctgcgcagattattaattgatgtctctaaaagcatgtgaagcttatcctcttctaagacgatagcatttacatactgttccatcatctcattatagcccggttttgactcaagcacttctccaaacatagcacggacagaaggattcatcctgtacggatacatcttattgttgtctacatctacatagtagatactgttgaagttgcttcctaaagcattcaccatctcactctcgttaaggcgctcatcaagctgctcagcaagccctattgcctcaactgttctgccatcatcatcaaagcaaatcgacttgaatgatatcctgtaggtatctgttccttccttggcatgcagtactacagtagcaaatttttctccctctgcaatctgtttaacagccttcagcagattattcctgtcaaccatgctgtctataaacggattgtttataatatccacatttttcccttctgagtcatctaatgaatcctctgataaaaaagacctcaaacggcattcctgcggaaagcacttaaaaacatactttccccaggatgcgaatgcggtctttatatccatctctatattgttttcatcatcaaatctattactcataataattcccacaaaaataaaataattattaaaactctttcatacctatcactactatatcattagtaagtcatttcgtaaagttttgtttttactaattttgttctttttgtgtattttatgaatatatgttttattttatagcgtcgagtgcgtttgagatatctgcaatcaaatccaccttgtcctcaagacctaagcttattctgataagctctgccggcactcctgcttccttaagctgctcatcattcatctgacgatgtgtgcttgttgccggatttaagcagcaggttctcgcatctgccacatgtgtctcgattgctccaagccttaatgccttcataaatgcagacgctgcctctctgccgccctttaagccaaatgatacgactccgcagcctccgtttggaagatacttctgtgctctctcatagtatttgtttgaaggaagccctgagtagtttacataggcaacctttggatgattttccaaaaattcagccactgcctgtccattttccacatgctttggcatacgcacatgaagtgactcaaggccaagattcagcataaatgcattctgtggtgactgcatagaaccaaaatcgcgcataagctgtgctgtacatttggtgataaacgcaccttccttgccgaatttctctgcatatgtgatgccatgatagctgtcgtcaggtgtgcacagtcccggatatttatctgcatgtgccatccagtcgaatttgccgctgtctacgattgctccgccgagtgtggctccgtgtccgtccatgtactttgtggtagagtgtgtgacaatatctgcgccccactcaattggtctgcagtttacaggtgtcgggaaggtattgtccactataagcggtactccgtgctcgtgtgccacctttgcaaaaagctctatatcaagcaccgtaagcgcaggattggcaatagtctcaccaaacataagctttgtgtttggtctgaatgctgcattcagctcctcctctgtagcatcaggagatacgaatgtagctgtaatacccatctttgccatagttaccgcgatgaggttgaaggtgcctccatagatggatgatgatgccacgatatggtctccgcactcacatatgttgaacatggcatagaaattggctgcctgtcctgatgatgtgagcatggcagcagtgccaccctccatagctgcgatttttcttgctaccgtgtcacaggttggattctgcagtctgctgtagaaatagccctctgcctcaaggtcaaaaagctttcccatgtcctcgcttgtgtcatatttgaatgtagttgactgaataatcggaatctgtctcggctctccgtttccggctgcatagcctgcctgtacacactttgtacctatactgtattctttcattgtgcttctcctttattatgttaatgtttcagttagatatagtatattacatttggcgcgttttgacaaattcttcaaatcgtggaagtgtgagagtaattttaccgtactcagaggtatctataaccccctttcttttgagccggtctctatataccgagaataatcctgaattcatatccagtttttctctgatttcttttaccttttcttcaccacttactgatatttccaacaatatttttttatcaagctctgacagctccgaccagattttactgtacacatactcatcaaggcactgatcatattccggtaaaatatcttctatcgtgtgatcatccctgttttcccagtaaagatatcccaatacctggaatgcaaaaggatatccctttgtaagagctgccattttgtctgcctctctttgatccagttcaaaaatatccatatagtgtttcctgactgctgtaaagctaagtggctcaagcattatcttaggcgccctgtacaaaaatgtaagtgccttgtcgttctgcagatcatatatattttcaaacagccccgtcataagcagaaaaataggataatcctgtctcagaaatatctgaaatgaactgacaaatacttttacaaattcacagttcgtaacctcatcaactgaaatgagtaaccgcttattatgtttctttatattttcaagcatcaattccagcacattttctatatccgtaaccggtgctgcattttctatggaaacgcccagtccaaacgctgaaaaatccagttttgcattgacaaatattttattcatctgaggcatactgtaaatcttagctgcaaggctctgaagcatatctctcgtagggttaagctcaactgtcagccattcctcatccttctttatctctgatactatattggtcatcataaccgttttgcccgatccccttaccccagttatcataaaaagctggtttgcaggattttctgacctaaatgtctctactatctgattggtctgtgagattcttgatatatattgcagtggttttttcccgaatgataatgtaaatggattttgcattttgttttccccttatataactttatataactttttgtttcgtatataagtttatataaccttatataactttgcatttattatataactttatataacttttgtcaccataaattcttaatctttaaaagcatctttataagatattttatctaccagcgcttcataactgctatcatcagcttgtactatctctctgacattgtgctgctctaatgctgctgttgttttttcacctattgagtatgctgtttccacgtatgcattctccggcagcatatgaaaaaatctttccacatttgatgcgcttgtaaaaacagcttcacttaccatgtttccaatgctttcaggaatactctcatatgcctgctcatttacatatgcatcaattttttctaattgacatatttctttaagccctgcctcaaggtcaggtgaagcctcctttgccgagaaaatgcagactttgatttcatcattatcgcccatatacgaactcaattctcctgcaagttcttttccggtctgttccataggaataacatctgcctttatatggtgctttgcaagctctttttctgtagcttttcccaccactgcaaaccttgcatttgctataatcctgatgtctgcccctgtcagctccagattatagaaaaatgatcttacaccgtttttgcttgtaaaaactatccagtcagccgatcttaccttattggcaaaatcaggaattattatcgggtttattatgcctgtcttaaccggtgtgacatctgctccaagctgctgtaattttgctatcaattcgtttgttttgatatacggtactgtgatttttcttccaaacagcggtcttttttcaaagaaatcaagcctgtcattcagtgaaaccacatcccccacaacgattatagccggtgatgtcagctttgcttcctcaatcttttctccgatatccgcaagcgttcctatacatttgcgctgcgcggcaagtgtgccgttcgatatcactgctgccggagtatccgctcttcgtcctgctttcataagccctgttgcaatgctttttacatgcgcaagtcccatcaaaaatacacaggtgattgtctcatctgtaagaagggaatagtctatatctgcctcctcatcccttctgctgtgcgcagtgatgacctgaaagccttttgctatgcctctgtgtgtgataggtattcctgcagccgcaagcgctgcaaccgatgaactgacacccggtaccacttctacctccacatttctatctaccaggtagagagcttcctctccgcctcttccaaagacatacggatctccgccctttaatcggactacaagctcatgatattttgatttctcgtacaaaagctcgtttatggcatcctgcttcatgacatgcttgtgattttccttgcccacataaataagctcacagcctgcctttgccattgaaagaaactctggtgatgacagcctgtcatacaccagacaatccgcctgttttatatatttttctccttttaaagtgagcaggcccgtatctcccggtcctgctccaactaatactacttttcctgtgttttctctcatgattttcctaattatttttctactgaattattatgattaaaaattatgccttgatattttttttagtcgatttccaatttataccgaatatcgtgcaccgcacgctctacaatattgtttctgtctgatgtcatatcccatacctgctctgtccttgcaagcttttttccatcctctgagccaaacatcgcaagaagctttagcctgttatttttgttgctgtcattaccgcggtctttttcacttacaatatcacagtatgcagccacaggcagatgacagtttccaccgattcgctttaaaaattctctctcaatgcctgcgcacagattggttttctcatctgacaaagcatcaagctttgccatcagcttagcattgtcagcacgtagctcaagcgccagtgtgccctgtgccggggccggaatcatatcatcctctgaaaagtactgtgtgatctcagaatctcttccgatacgctttattcccgccgctgcaagtacgattccatccagcctgtattcgttatacttattctgtttttcgttagctatctcattgttatttacagtattatcggcaatctcttcatatataatttcaccatcatatagcttacgaagccttgtatcgatatttccgcgtatgccaaccaccttaaggtcaggacgcagctttaaaagctgatactttctgcgcttgcttccggttcctatcacggcaccatgaggaagctcatccagtgaagcggcattttttagtaccaaaacatcccttggatcttcacgcttccatgcctttgcaaatgtaagccctgctgccggttcatcaggcatatccttcatggaatggactgccatatgaatctttcccgataaaagctcgtcctctatctcctttacgaagataccctttgagccaatcttatcgagtgcctttttctgctctaaatcgcctgttgtctttatgataacagccttaaaatcatcatccggatatgctctttttaacttatctatcacgtaatcagtctgaacaagagcaagctttgagcctctcgttcctattaaatacctcattttactctcctacggatcatgccattttccatttatcatttataaatgaacaacaacttaaaatctgtaataccatactttaaactatatttcaggaatccttccattatcaatagctgcacacaatatttccttaaatacacgctttctctcggcttgagtgtcatattgcgctattactttttcgcggatctgtcccatgtattcgttcagctcaccaagaaacggagtaagaatctcctgctctttgcctttcagatactgagtcagcacagggctgtttcctccgctcgaaaatgccgcaacaagattcttttcctttatgtatgacggaaaaataaagctgcaatcagccttttgatcgaccgcatttaccatgatgtccttagctttgcaatactctgcaatctcatgatttaaagcattgtcatcagtggcagcgataaccatttccatgccatcacagtcttttcgttcaaaccttctttttatgaacgtaattctatctgctgcatccgggtccgtctgattgttttctatatttgccgtatatgagcccgttttatcctcgcttgctatatcatcaattgtaagctttctcagctcatcacatatatcctctgccacaaccgtgacattcgcgccaaaatccagcattacgatcaccttgcggtatgccacatttccaccgccgacgatcagacactctctttccgtcatatccacaaacatcggaaaatacgccatttttatctccctgtaataccatatccatactttatttcatatattatttcatgccttattttatactttattatacgctttatgctttattttttgccttatgcttcacactgtatccattgagtattccttcaaaaacaggacgaagcttagcagaaaacactgctgccgatacgcataatataaagtccggtgcaacagttatcagacagtaatctactattactatgccccagctgacaggtgttgccgcatagaaattcttcatgcagtaaaagtatattgctccaactgtataatatgccaccagtccgaccgttgccggaagaatgagtgtaaacgcattggtctttttaaacttttctgtaatcgctccgattaaaaatgcggcaagcacaaagcctaagaggaacccaaagcccggtcttaaaatgtatgtaggaccaccgcctgccgcaaatacaggcactcccaccagtccgatgcacaaatacactatcacgctaagcgatgccagctttgccccgagcagaaatcccgccatcagcacaaagaaccactgtaatgtaaaatgcatggtgtacataggaagcggaatatcaatcttgataaatgctccaactgctataagtgccgcaaaaagtgcacatgttgtaagttccttcgtttttaatttcattttcgaacgctctttcgttttattaaatatacatgctataataacatctttctctaaaaaagaaaagccatcttcgatgaagctgacttttctttgcagctttcgctgcgactcaaaacattaacatatgatttagaagtaatattcatcagaatatattcgtaaatcctctttcgtgacctgtccaccctcgatatgaaacgagttgattacaggattttctgccataagcgacattatcatgtagctcgcatttggatcgtatgcaagctttatatcctcatccgatggccttgaagggctagacgggtgtgaatgccagttgccaagcggcttaaggccgtttgctctcatgtcctttatggctgccagctgctcccttggatccattgtgaaatggtcctcggcatggtctgtattcgtcaggtaatatacctttgtgatgagacgaccgttttcgtcctcactgcctgctatcagaccgcacgcctcctccggcagatgctctttagcatattttgctatttcatccagaaacggatatttcattcttatgatactcatatcgttcctttccttactgtctttttattcctgtgtacgaggtgcatcaaatctgcccgctgtctcctcgcagacctcctgctcgtagtcgattggctcgagaatagtcggatggtcgccacagactgcacagttgtgtgtatcctttggaagcttaatcttgtggaactccatggtgagtgcatcatatgtaagcagatatcctgtgagcagctctccaacaccgattaaatacttgatagcctccatagcctgaagcgaaccgattactccgcccatagctccgataacgcctgcctgcttacatgtaggcactgcatcctttggtggcggattcttgaatacacatctgtagcaaggtccctctcccggcacatatgtcatgagctgacccttgaaacggatgattcctgcatgtgaaaacggctttttctcaagcacacatgcatcgttgattaagaactttgccgggaaattgtcagttccatcgatgatgaaatcatattccctgataagctctctgatgtttgacgcatctacaaacatacggtatgtattgacctgaacatccgggttcatggcgttcattgtctcttttgctgactttaccttggctttgcccacatcggctgttccgtggataatctgtctctgcaggttggataaatctacctcatccgcatccacaataccgattgtgccaactcctgccgctgcaagatacatggctgccggagctccgagtccgccggcaccgataataagcaccttgccctttaataatttcttctgacctttaacgcccacctcattaaggataatgtggcgtgaatagcgctcgatctgctcatcagtcattgccattagcatccacctcccatgaagtaaaggaactctacattgtcgccatccttaagcactgtctttggcttatcctctgtggcaacaaattcctcatttattgaaactgttacatactcaggcatatctacattctcaagctcgataagctccggtaatgtaagtccatccttatattctttcttctctcctgctactgtgatagtcattttatttcctcctgtgtcacagattgtggtatctgtatgtgttattatcctgtatcagactgctttatataataatctaaagactataataattcttcaacccatgctttcaaatcggcaggcttttgtgcgccgacctttctgtctaagacctctgcgtcttttacgaaaagcagtgtcggattcgcagtcacctcatactcatcagcgagctctccgtcaaagtttgtgttgaccttgtatacgtgaagcttatcctcataatcatcctcgatatctccgagaaccggtgccagcttcttgcaggccacacatgaatccgagtaaaaatcaacaattaccggaagcttgctttttaatactttttcatcgaaatccgcctttgaaattcttgctgccatgattagtcctcaacctttctgacgtaaagagtgtatgttccatcctcgttgtcctcgagcttaagtatcttgtgtccctcttccttcatgcttcttggaacattctgtaccggctctccatcattcatacggattgcaagcacctcaccgtcatctaattcctctattgctacctttgcctttacaaatgtaagagggcaaaccttgtcagttatatctacctgatcgtcgaatgctatatctgccattttgcatcttccttcctatactcatatttattatatttttgccgtaaccgttgttgtttatgcgtgccggatatttcctgctatacatggggattatttaccctcgtatgctgcctgaatctcttttttgaactcttcctcgcccactctctgaagagtaagtctgaaacgctcaccaccgtttgcatgcttctcgaagaaactaattgctgcatctgtcactctgaaaagagtttccttgtcgcggataatcggaacaagctgctctcctttatagatatggtttccgaaaagtcctccaaacgatacgatatatcccggagttcccttccatgcatctgtcggacagctctttacgcagcgcgcacagttgttacatttgtctctgtcgatgacaatcctgccatcctccattgaaagtgcaccctcgcggcatgccttcacacatacaccacactggatacaatcgtcatggctgcactctactgtcatgccgcctttgattccgacatcgttttcctcagcctttaagcagttgttctgacagcctgtgacaccaaacttgaacttgtgaggaagctctcttccgaagtatctttcatcaagttccttagccagagtgtatgtatcgatacatccgctaggacagatttctgagccctgacacgctgtgacagtacgtactctcggtccgcagacacctgttcctacaccgccctttgccagtttctcttttaccacattgatatcctcaaccttgataaaaggaatctcaataccctgacgcgatgtcatatgaacatatccgtgtccatatttctcagcaacctctgctactgttttgatattttctgctgtaagatttcctcctacaaccgcaattctaagcgagaaacagcccttttgcttctgtctcataaatccacccttttttagggccgcgtaatcaactttctccgccatttttagtctccttactgtgtaaatatgttaatgttttgttttatatgtaaatgcatatgcacgctctcatttgcatacacattgataccttattataacggcttaatcagctatatttgcaaaagcctgtgcaaaatcctccttgaggtcatctatatcctcgatacccacgctgactcttataagatcctcaaatactcctgcatcctccttctgcttatctgtgctgtgaagactgattgtggagcccggatgaatgacaagtgtctttgtatctccgatattgctgagtgtgtatggaatcatcaggctgtctataaatttaaatgccttttccttgctgccaaccctgattgtaaggattgctccatagccgtttgtgagctgtttttttgctatttcatgccatttgctgctacaaagccccggataattaacccttatgtcaggataattgttttctatccacgacgcaagctcgagtgcattagagcattctctttccattctaagaccgagtgtctcaagtcctataatatttaagtatgcattcaccggagctaaacaggcacccatatttctgaaaagactgtttctcagctttgcgacaaatgccataggtccatacttcacataatctgcaaaccctgggtatctgttcttgtcccatttgaacttacctgagtctgtcagaataccactgattgcattgctgcttccattgatatatttggaagatgaattgaccacgatatcagctccatgctttaaaacctgtatcaggtaagctgtcgatgtggtattgtcaactacaagcggtatatcatgtgcgtgtgctatctctgcaagcttctcaatatctgtgacatccagacagggattaccgatagtctctgcaaaaatcagtctggtatgctcattgatgctgtcctctatctgctgccagttgttgttctcgacatatctggttgtgatgccgaaggcctcaagatcatggaacaaatctattgtgccaccatagaggctggcgcttgagatgagctcatctccactgcttagtatatttaagaaggtattcatcagtgccgccatgcctgatgcgcatgccaccgatgctattcctccctcgagctttgttattctgttctcaaaagctgtaatcgtaggattggcaactcttgtgtaacagtagcccggagctttgttttcaaatattttttccagatctgccgcgctctcctgctcgaaggcgcttgtctgatataccggtggcagtgtagagccatttgtctcttttgtcacgccggcatgaagtaagcttgtattaaatctcattgttttcttcttctcgttaattcttacatagtctattgtgttactaggaattgatgagattattatacaaacgtgtgtgttgaaagtcaatgctatcagttatacaaattatttgtgcgtggttatatattttatttatatccattaatgtcccttaaatactctgcggctgtcgttgcggcatttgctccgtcagatactgcggttaccacctgacgcagtgtcttggtacggacatctcccgccacatacagtcccggctggacgcttctatcatggtcaccattttttgttgcagcatatgtgatgccgtcctcacctgccactacatatcctctctcatcaagctgcaccagattctttataagctctgactgcggtactgagccatatgccacgaatactccgtctacagccagtgtcctgccacttttaagctttatgcctgttggctttttttctccatatatttctgtcactgtttcgtttaggacaagctctacattttctttctgctttaagagctcaactgtgctctgtgcacctcggaagctgtctcttctgtgaaccagatagaccttctcacatatatcggacagatataatgcatcatccaaagcggtatctccgccgcccagcactgcggctgtctttcctttatagaatgccccgtcacagattgcgcagtaagatactccctttccggtatactcatcctctcccggcactcctgcctttctcggatatgctcctgcggtatagatgagcgctcttgcctctgctatcgtgtcatcatcgaatttcactctgtatatcactgattcttctttctcaccattttgcactgcttctatctgcactgcttctttttcgataaattctacatcaagagacactgcatgctccctgaatttttctcccaggtcgtatccgtttatgtttggaagccccagatagttgttcacatttccgctctcggctatctggcctgtcccctcgtattctttttctgctactgccacattcagattggctctctttgcatatattgctgcagacagtcctgccggaccactgcctattattattatatcaaacatggaattggttcctttcatcgtccattgaattttttcggtaacttattatatacattatccttaaaaaatacaataataccgcctgcttttataaaacacctttataaaaacaagcggtatcaattttatctatcgtatatacatcctagcctcataaggtctgagcactgacatatcagaggtatccttataatttgatatcagcacctccatgccctcacactcctttgcaagcggcattggtatctccttgtcaaagaaattgcacacaacaatcatggttttttcttcattctttctgctgtatgcaaaaatattctcatcatcctcaagtaaaagtgtgaatttaccatcaacaaataccggataatcctttctcagctgaacaagcttcttgtagcagctaaagattgaatcagggtcatccacctgtgatttggcatttattttgtcgtaattgtcatttacttttatccaaggtgttcctgtggtgaagccggcatttgccgagtcatcccactgcataggtgtccttgcattgtcacggccctttgcgtaaatggacttcatgatttcatcctttgagtatcctttttcaaggcgctcatggtacatgtttatgatttcacagtccttataatcctcgatatcatactgtacatttgtcatgcccagctcctcgccctgatagatgtatggtgtaccctgcatgccgtgcagcaatatagcaagcatctttgcagattccactctgtactccctgtcattgccccatcttgacacgatacgcggcaggtcatgattgtcccagaacagactgttccagccacagttgtagagctcattctgccagtgagccattatctttttgagctttttaaacggaagcggtgcaaggtcccatttctcgccgccctccttctggtcaagccctatgtgctcaaactggaacaccatagaaaactcgctgccatccggattgctgtaaagctttgcacgctctgtgtctgcgccccatgcctcacccacggtaatcaggtcgcccttctggaatgtctccctgctcagttccttaaaatattcctgaagccttggtccatttatggtgattctcttgtccggctcttttgctatctggtcgattacatcaagtctgaagccgccgactcccttgtccatccaccagagaatcatatcgtagattgctcttctgacctttggattctcccagtttaaatccggctgctccggtaaaaactgatggaaataatactgtccgatttccggcacatattcccatgcgcttccaccgaaacaagccttcatatcacttggcggcacgccttcatctccgtctctccaaatatagtagtcatggtatggattgtccttgctctttttagcctccttgaaccacctgtgctcgtttgaagaatgatttaagacaagatccatcataatccttatattgtgcttctttgcctcgtttatgagctcctccatatcatcgagactgccaaacgtcggatcaatatccctgtaatccgaaatgtcataaccgttgtccgcctgcggtgatttaaataccggcgacagccatattgcattgattccaagggtctcaagataatcaagtcttttgatgataccctgtaaatcaccaaagccgtctccgttagaatcctgaaagctctttggataaatctggtaaactaccgcctttttccaccatttttcattattgtttttgctcattatgccctccttgtctcttcattatctcttttagctgtctctttttgtaaaaattcagcctggtttctttaatgctgtatcaaattatgctattttacaagcaccaccaaaacctcacagctttcaagcttaagctcggatgctcccactgaaacagtgctcttttcagcatcatttgcgttggacaaaagcacctttttcacactgccatccagcctgatttgtgcctctttactgccaaaatttgccacaaccagcacgcgcttattttcatcctctctgtaataagccatgatgccatctgtatcctcatatgccggaacacatctgccgtaggtgaacagctccttaaattcatctgactttctgagtgccacaagccttctgtaatagttcaaaacagatgaagggtccttttcctgcgccgcaacattgatagccttatagttttcattgaccttaagccatggctttgctgtggtaaaaccggcatttgcctcatcactccactgcataggtgtccttgcattatccctgctcatccttccacaggctgcaagtgcctgctcctttgataagcctgctgcaagtgctgccttgtactgatcctttgtgcttatatcgtcatactcatctatactgttccatttggcattttgcataccgatttcctgtccctggtatataaacggaatgcctcgaagcagtacgctgacagttcctaacatctttattccggcaggattttgagcatgctttggtaaaaatcttgaggcacctctcggctcatcatgattttctataatattggccttaaagccgtacttttctgtctcaagctgtgaaccaagaatggtctttctccatgtatcaaaatctattttcggtgcatcataccagccatgctctccatcacttaagcactgtgcacaaaaatcaaatatcgttgaaaaatgcccattctcaccgataaactccggcagctcctcaggcttcatattgaatacctcgccaaccgtaaatgcatcatacttcttaaatgtattgttctttaattcctctaagagctctccgacaccttctgcactttcaaccatcttgtagcaggcagccagtccatcctctgcatccggctcaaaatcagggaaatcgagatttttctttatattgattatcgcatctattctaaatcctgacaagcccttatcaagccaccagttaatcatctcgtaaagcttttgtcttagcttttcattctcccagtttaaatccggctgctccttcgcaaacatgtgcagataatacttgtccgtgcccggcaccttctcccagcagcttccgccaaaataagagcggtaattgctcggcggattgccgtttttaccttttctgaaataaaagtaatcagcatactctccatccggatccttaagtgccttttgaaaccattcgtgcttatccgagcagtgatttattaccagatccatgatgatgtgcatatcacgcttctttgcctcggcaaggagctcatcaaactcctccatagtaccgaactcttcagctatcgcatagtaatcagatatgtcatagccctgatccacaaatggcgatttatatatcggagacagccatatgatgtcaattccaagcgattttaaataatccagctttgaaatgatacctcttaaatctcctattccgtcaccgtttgtatccagaaagctctttggataaatctgatatgccaccttgtcatgccaccattttctctccataatgtgtacctcttatctaatcataaattttgcactcatttacagcttgagcacttcgccttgatgtattatactgctattatagaaagtgtttagtataaattcttgcaatattttttcattttataacacaatactgctctcataatttaaagggtataattttaaaagctatggagaaacaacaatatgaaaaacaataatccgcctgccctcgggcagaaagaaaacgcaaagcacggagaagtattttttcccgttcagaaatatataacaagacttgcagcagattaccctgtcatcactacacactggcacgatgaggcagagctcacactgattacaaagggctcatgcacctatcagattgatttgctcgaatatgaagcaaaggaaggcgatatcatctttatcccgccactgctgctgcattccatttcaataagggactgcgacgaattttactcggaaacgtatgtattccatatcaattttttaggtggaaacaataccgatatatgctcttcaagatatctgactccgctaatcaaccatgagttcgccatgccttacctgattgcaccgaagcatccggcatattcatccctttgcaaatgcttcatgcgcataacaaagctatactccagtcaggaattcggctatgagctggctctaaaggcatttctgcttcaggcaatatttctattgctgcaatacagtgaaaaaaatgctgattttggtgtcaacacatcctccgataagctcaaaaatgtgctcgattacatcgaggtgcactatgccgaaagcatccaggttgcagagcttgccgggctttgctatttcagtgaataccacttcatgcgtttcttcaaaaaacacatgaacatgacctgcgtgcagtatatcaacaatgtgcgtcttgaaaaatccgtggaacagttcgagcgcggcaacacctcaattttagatgtctcactgtctgtcggatttcacaatctgagctattttcacagggcatttaaaaagaggtatcatatgacacctctttcctttatcaaaagccttgaataactatttatttgcacgcaatcactctgagtatatactcatatgacctctttgcagaggatatggaaagcctctcctcagtcgtatggatatcatacatgtccggtcccattgatatgcagtcgagtccttcaatcttgccgcttaaaagtccgcactcgacaccggcatgaatagcctcaactgtaggctttttgccatacatctcctcaaaaatccgtaccatatcctcgcggagctttgaatccttcttgtactcccatgcaggataatcgccctcaaatgtaacctctgcagcaaaagcgcctgctatgcatacaagctggttcttaaggctttttttagccacaccgacagagcttctgactgcgtatcttaaagtgacagcagcatcgtctgattttaaaactcccagattaagcgaggtctcaacaagcttatcgatttcccggctcattctgatgatgccgtttggcagtgcctcgataagtgcgataacccttgcgctatcctttgcacttatagctgactcactgcagtcagtctcctctgacacagcaagcttaaggtcaggatcagatgccttaaactcctccgcaatctcagctgctgcctgttctatcgaagctttcactgccgcagcctcatcaggtgctacaataatctgtgcagtacactctcttggaatggcattatcctttctgccgccctctatagaagctatagctacaggtgccgatgcgtcgcgaagcagtctggacataagagtattggcattgccccttcccttatcaatctctgagcctgagtgtccgccggtgagacctgataagctcacagtaagctttgttccgctcactgtctctctctctacaggcagcttcacatcggctctgcatccaccggcgcagcttgcgagcatcacgccctcctcctcgctgtccatattaagaagcttctttcccttaagcatagacacatcgatgcctgtagcaccctccatgccgacctcctcgcatacagtgcatacaaactcaaggcgtggatgtgccaggctgtcatcgtccaaaatagcaagcgcatatgccaccgcgataccgtcatctccaccgagtgtagtgccctttgccgagataaaatcaccatctatcaaaaggtccaggccttcctcgtccatatccttatcacagtcaggtgccttctcgcaaaccatatccatgtgcccctgcagtatgattggctccacatcctcgtatccttctgatgcttcctttatgattatcacattgtgaagctcatcctggtaatgctcaaggcctcttgcctttgcaaactccaccagataattactgattttctcttccttgtatgatggatgaggaatactgcatatatcctcgaaaaacgaaaaaacattctttggctctaaatctgttaatactctcattttactctccttaaaaaaagtctgccgacgaatccgccgacagacatattataacacaatccggtatttaattgtatatgtattattcaagtccaaatcttctctttacggcatcgaccagatagtcggctgtccctcaaagagcttatcctgcagctcgtcagcctgtgtatcaaaaatgtcaaatgaatttggttgttggggacaaaaatatcttctcatatctataatgcatctctcacaatcataagtgcaaagccgagcagattctgtcctctccacttttccatttccagtcttttaggatccgtcatcgacaatccaattccccatatgcagtccctcacagcacattccgctaaaacggcatctcctgtagcttttaatttggctttcaattctggattttgaaattttgcacaaagtccattgtaaacaagaatctgtcgctttccattccagattgtttcattataatttgaaacctttcttcccaaagccttaatttgtgcaacatctgtagtttcaagaatcttctctgctattttagtatccccaaaacaatttgctttttgatacatcatgtactgttccatcgatgaaaatcttattccattgcattcaaactcacttaaataccaattactgaggtatccattttcctcatccggattatgaaaacaaactatactcattataagtcacctaccttttcttttttattatttttcatatatgtgtttataaaatcttctgtatcactatcctaataataggattgtatcacaaaatccaataattcacactccacttacctcttccgcaatcttcctaaccttacctgcatccgcacactgatagcagtttttcatcgcttcatcatacgaaaaatctactgcattgcccgctgctgtcacatcacatttccatgagccacacgagctgtgcacctgcgtaatacctgtgtattcgataagtgctctcgcattggtatcattcacgccgcttccggccagaatcgtaatatcttttccatattgattttgaagatgcttaagctgttttctgccatcccatacatttactgctccaccgcttgtgaggatacgatctgcaccaagcctaataagcttctccgctgcactgtcctgattacctatgcagtcaaaggcgcggtgaaacacagcttccctgccatactcatgaatgagctctatcatttccttcgtgcgctttttgtcaagcattttttcctctgtcagaaatccaaacgcaataccatctgccccatgctctaaaagaatttttgcatccataagcatagtgtcgtattcttcgtccgaatagcaaaatccaccgccccttggacgaaccattgtcactaccggtatattgcattttccctttgcatatattaaattggcgagtgtcggtgtcagcccgcccatgtatagggcgctgttgagttcaaccctgtctgcaccattttcatatgctgttttcacatctgaaaagctgccgcagcagatttcaagcatcggtttcatcatactttcccactctttccgctaaaataaagcttaaccttcacacaatacatgtgtggccgacaataattacataaatcatttttacgataatcaatattcattgaccacaatctcgaatactccgtcctcattaatttttaacctcaatgacttaacatatttattgtaaaaatccttcatttctcgctctgtcgatgtaattttagtcctctcgtatatctgtcttgtcatctcccagccattttttccgacaatatcatttgtcagatttttcaattcacttatcatgacttttttctttaaatcacttgcatttcctgtatagaaatcatctattgaacaatgaaatatacatcgttttgtaagtgcatccttgattgactgtccgcacttgctatattcgtacatcacgaggaaatgagcatcctttaccgatgaaataagtccccagtaatccgaatcacttgagcacaaaataaacgagtctatgttgtccttataatacgcctcacacactcccgcagtcatctttatatcaacaagcgactttcggtctgtcacacgctccacctcctcgtggaataccgggatatgtatgaatttttccagccagtcccatccacaggatgtatgataatcatcataaagtataattttttctattttggacatttgctcagaatttaagttttttaatactccatacagcttgtatacatcagaattttcacaatccacaactatcacaacacgcatactttcacggataaactcatatatattttcctttgtatcttccactgcatccctgtattttgaaccgtcattgaaataatcaccatgctgtctgtatattgtctttaatatacgtccgtcggaattgagcagatttcccctgccatccgggcgccagtgaatgtacatcccgtacggatactcttttctgtgctctttatagacagtaaactctgcctttagcttctttggcttttcataatccgctataacaaacaagtccctgatatactcccattttacccagtctgggaaaagctttttgcatgcatccacgtgctcatttatcagcttgttaatatgtacgcaatacttgtcagccgatgaattatacaatataatatgcacttcccagctctcaagcatatttatattctctgcatcaaaccactccatcctgtttatattacccagattatattttatttcattgtctgtttttttatagttgcgcagcagacttgtacgtgccttacacagatatctgagtatcctcgcatttgtactttctcttaagctgtttaaaagctccacatactcatcactgcacatattatcaagtatctcatttctgacacctataagatacgatagaatcgtcacaagctcatatttctgtactgttttatattccttttcctctgtaaattcaaagtccaacgcatatgtttcttcatatgcttcttcatctgtttcctgtatcacattattaacttcatcaatatctgtcaaatctatttccccttcattttcaaaatatattaaaattatatcatatgttgcactctttgtattgttaacatttacttaaatctatattatttgccattttctcctacacatgctacaatacctttgtccggattaatggtgattattatcagacactttttagtagacagcgaaaatgtcaacgacaactggctgatgctgtttgatatggcagatgagaacgatgaaatcgtagttttttataccaaaaaatcacctcacatgtcatacatgtcagtcatcaggcttatggaaaataacagtattaatgtacgatttgaggaatgctatgagggaacgaatgcccttgattttcagctggtatcctatatgggttatctgatgggacgtaacgatacccacagtgaaaataattcttcagctactcctatcgtcacagacacagcagatgtatcaacagcctcatgtgctgatgagtacatcataatgagcaacgacacaggctatgaccctgctgtcagattttggaaagataagggatacgctgtgcgcagattcaatgtgaacttctgcaaacaggctgtccagcgaaggaaaaacatcaagtatcaggtggtagcagatattccgtctaaggaagataacgcaaataccaatatcgatacaaacatcgataccgataatgataacgatgctatcactgcaaagtcttataatctgaatgaacttttcgatggcaatcatagcagctatacagacaatgaaccgttaagtgatgagcttgcggctaacgatgatttaccgtcaagtgataagcttatgactaatgatgacttaccattcactgacgaacagacacctcataacggttctggtaacagctcaaataaaaacgaagcagatgaggctaaatcctcaacggacagcattgatacatcagatatttctgaagtatcggcagcatccgaagacttcgaccattttgaggtagattctttcttaaactgcatgggaaaagacaatctgctcaagcttcatgagacactggttcatgtttatggtatgaaacagggtcagacaatttataaaaccataaaagacaaatcctactcttatacgcctgaaaggctcacgcgtaaaaagaaggtagagcgttttacaggtataattttcgctcatagtgatattaatgatcccggagattttgttgattttcttgaaaaaaacaggaataaaacaaagaatctcaatggcataagatctgccatcacaaagagctacggtgagacagatggtctgaaatattacagccttttcaagccatatttcaaaattatatctgcactgaaataacgccctttattttacaacagaaaggtaatccggataaaacaattgaggcacggaattgatactccgtgcctcaattatgttattttttgtttaattaatttttttcagccactcatccggttctatagctgataccacagaagcttcaaaatctgatgtatttcgagtaattatataatttgctgaaacttcctcggcacatctgtcctgcaggcagtcctcaaaatctataaagttatccattttaatagcagccatgaccgcttcctgtgacgcacatgctacttttaaaaccatacaaaccttttctaaccataatcttcttgtttctgctggaacttttctaagaatataccaaagattaggcaaagaatgaaatgccatgtatccatcggcttctccagaagcacatttctccattacgcgcaaagccgaatcataaaacggttctcttgcaacaagaaaatcaataattacattcgtatcaatcaatactatcatatctttcctttcttgcggcttccaactctgcatccggatcaaaatcatccggcaaatatttttttgcttcatatctggtcgctaccagttctttaaacgcctgcattttttcatctgatttctgagacggataaataacacttgtatatgttttctttggtattaatcgttgaatcacttcaagtaaaaaacctacattatcatcggacatatcctgaatcatccgaacagcttgctcctgtaacatagtcatgtgatacaccgcctttcctcattactttatgaaaattattatttcttagtttaattataaccgctttacactaatttctcaatcaatatttaaccaaatttgctggaccaaaaatgaatttctaaattccaccgcccaatagggtgatggaatttactctcgcacagtagatatttactctttcatacaatcatgttatggttatgactccttctgacagcagtagaaggagaatcattatgagtaaatatataccaggaaaccagaaacaccttactttaaatgatcgtatctatattgaaaatgaactggcaaaagggactccctttaaagacattgcagcatttctatgtaaagatccaacaactatatctaaagaagtccgtgctcatcggctttcagattggtatcacaaaggtactttttataacgcaaagaacttttgcattcatcgttaccattgtcaaaagaccaatgcctgtggaaaaatccttctctgtggcattaaatgtgcctcatgtcctacatgtaatcaaacctgcaaggactttgaaaaagaacgatgtaaacgattggacaaagcgccatatgtttgcaatggctgcacgaaaaagataaatcactgcacgattgcacataaatactattacaacggccgtgctgctgacagaaaatatcgtgaactgctgatatcttctcgttctggaataaatatgaccaagcaccagctccatcagaaagaccagatcatatctccattaattgagcaggggcaatccccttatcaaatccttacaaatcacccggaactggatatgtctgtccgttctatgtacacatacattgacaaaggactcttcacagcaagaaatattgatttgaaaagacaggcaaaattcaaaccacgaaagtgtcataaaacacaaatcactgatcgttctgtttttacacacagaacctactctgacttttgttcattagacctgtcgtcttttgtggaaatggatacagtccattcctcaagagaatcaaacaagactctcctgacactgttttttacgaaagaaaagctatttcttgcctttttacttaaccgatgtaccaaaggtgctgtaagacttacctttgaccgtttagagaagcgcctgggcacatatgaatttatatccgtttttgaaaatatattgactgatagaggttccgaattcggagatccggtaagccttgagacaggcattcatggaatccagagaagcagcatctactattgtgatccaatgcgcagcggacaaaaaggcgctatagaacaagcacacacaatgcttcgtatggttttaccgaaaggaacttcttttgaattcttaacacaatgggatgtgaatctcatcgtaaaccacatcaactccactccgcgagaaatcctcagtggaaggacaccatatgaagttgcattagaaacgcttggtgaagatatcttaaaagcatttcagcttaagccgattgaaccggataaggttaatctgacgcctaagctgatacgctttaaccattaataaaactaatcgaaatctgctgtcagactggatgtaaatttttcacatttttaagatgcggctggtggaatttagtctagcacaccgaattccagtagcctatttagcatgtctagaaatcgagaaaatttcgataagtaacattaattatagcagaaaacgagagatttagtccaaaaatttcttgttaaaccagcaaaatttaaatcacgatggaatttactcttgcactggaatttactttttcaagtcagccaaatttgctggacagattctgtcaccggtagatttgtccgctttgtgtactacaatattgcgggataatctctcgtatagtgcagtgattttgtttagttccggttgttttgttttcataagattctcccttcaaacaaacaaccagcctatctgtggttttattctaccacggataaactggtttgtgtaaaaataattattgtctcactaataagagaaatccgatagaaaatctaaactgttttataagtatcatgagattttaataccataaatttataggaattatgggagagatattgatgcctttgttacaaaaatatcaagtttcctgtctgttgtcatttgggtaaacttgaagttatagtgcaatctttttccattttctaatcttggttctaaaggtcccgaacggagcaactgtattaacatgtatgaatttgtatacttcccagacagctgttttagttgcttcatcagcccattttctcatatgtggtttaaataattcttcctcactcagagaatcaatcattgcataaatagagttgatattctcattcaatctgtctttcaattcttgcagtgacagctgagcatatgtatctgtgaaccattgatataattcgccaagctgattccacttaaaattatccgaaggagttttgacaggaataccctttctttcgtttgattcccatttaataacaagagttgtccagccaacctgataagcaagattttcagccggagttcgatcaatctcatcaattctcttatcttttaaatgctcaggaatatcattaaattctgaaatatactttgcaaagcttttatttatctcgtttttaagctcgtctttattctcatatgttctcaatagtctatctcctcagcttccgattttacagtttcaaaaacaggaattttcaaattagtctttgcaaataacctttgaaccttcaccatcgattacaattccctgacggttgttaattgggcatagattcaaatccgaaaactcagtcattattttctcggtaactttcttaaatggtgctgtaagataatgcggaagaacatagaaatcaatcaaatcaagccctgcatcatcttcttgtgagtagtcctctggcttttcatccatttgctcgatatattggatgcttggagcgcatataattgcgcctgccgactcgccgatcatcaattttccgtttgccaattcctttttcagtagcccatcagttcccgttttacggagctggtccacaagaaagaaagaatttccgccggtaaaatatatcacatctgcttcttcaaaaacagactgtatcgttgaataagcctcagttgaaatatcaatttcagttacgattgctcccaactttttgaataattttcgagccgagccgacataaccggtgtagccttcacgcagtgaagctgttggaataaatgcgactttcttattttcaatttcttcctttatcagacttcccacacttgaaaagtgcgaacataaaaatagtttcatcaatattctcctttataaatcccgatttcactctctattgtaccacgcacctggtcaagagtgaagccccgctcaaacatgtgcccgcagacttcggtggatattactgttcttacggcctttgtgtaattgtctccgcttttttggttcctcattgattttatcatatgtatctgttaattccgtcatagcagcttgcctcctttttatttaaagtatgtcagaagcatatttaggttttggtcttccatataaagcaatgatggaagagtggtgtttacgaatagagttcctgcaaagagctgatacgtttcagacttttgtgtcgcagttgctcttttatgcaataatatctttaaacgactgtttttcggtcatatgcataaatttatccaaatttacgacattttcgttgaataacatcagcatctgtctgccatcagcccatggatacagccggtcggcatgaaaatgtccaaaggcccatctcttataatccaaattaaattctatctcacccagatacctttccatggttgaatcaacagtgctctgatcaagtcctgcaagaaacaaatcggttggttcatatagatatgggcatgtatgcgaaagtactaaatcaaacggggcctcatttctgcacaattttcttccaagttccatttctttttcatctaattgctcatcctcataccacgtcaaatgtctggctagacgatagtacttatccacgctgtaagcaccgggcagagataaagttttataagacttaaaattatatactgccggtacgtctgctaaatactcaatgtgagggaattctttctcaacaaatatggaaccatcatattttgatattgtttcccagccgtcaggatttttgtctataaccgtttttactctggcttcatgatttcctcttagacatataaaggtaaatggcagttttgaaagctctgatttgaatttgtggtctctctgaccagtgagagcaaaatttgcaccaacatcgccaagcagaatcatgtagttttctgatgaatccaaactcaatctatccttgttcttttgataaaaatagtaaatcggctgtgcgctgccatgtatatcacccactaaaaaccattgttcgttcatcacattatctccattttactaattataatgccatatttaggttttggtcttccatataaaacaatgatggaaaagaagtgtattttaatatgtcagcaactatcattttatattttgatagttttctgcaatctctttcaaacttcttggctcataatcaatccacggcttcatgcagcctacattgtatgcttgaattgacttatcacctacatggcggcagtcattttcttccattcctgccagacacttttgaaaatatacgtcctctgcactgttgtgagtatgaccgtataacaggattgtgcctctgttcatgcctttccatgaaaatataggataatgacacagtacaaggtcatagttcttaccgccgtatgagtcgtgtatctctctgtaatcgcatatatcataaaaaagctgcttatatctgtaatctgatacatcatcatggttgcctttaacaaggatttttttaccttttaatgtagcaacaagcgatatgagttcttccttcctgcctctcatgctcatatcaccgagtatgtatactatatctccattgtttactttattgttccatcggctgacaactgactcatgcatctcatccaaagagccaaatggtctgttatcaaagcggattgaggcttcgtggaacagatgcaggtcacttatatagtagttcattaatccttactcctcctaatttatattacattttcaactctatacaattttatccttagaaaacataaaatccacattatctccttccaaaaaaaaaggaaaccttttttaatggctgagaatcaccaagtattcctattcggtttattatataatgtgcgtgagagggcgctggaagtccggtggacttccgcttagcgccgaccgcaacggagtgtagagcgagccccggggttcaaatcgtccggggacgatttgtaatatagaaaaagcaggtattaaaacctgctttttctatattatataacgtgcgtgagaggattcgaacccccgacaccttggtccgtagccaagtgctctatccagctgagctacacacacatattttatttactcattcattataacactcttgtcaagtgctttgaatgaatgccgcagaccggaatcgaaccggtactgtatcactacaacaggattttaagtcctgcgcgtctgccagttccgccactgcggcatgaatgggacctacagggctcgaacctgtgaccctctgcttgtaaggcagatgctctcccagctgagctaagatcccatataaagaatgtagcaaatactcactacaaacgacccagacgggactcgaacccgtgacctccgccgtgacagggcggcgctctaaccaactgagccactaggccaaatgcttaatgcgtgatatataatatcacagtttgcacaaaaatgcaagaaaaaatttaatggaccatcggggactcgaacccaggaccgaccggttatgagccggttgctctaaccaactgagctaatggtccaaatatataagccgatgatcggactcgaaccgataacctgctgattacaaatcagctgctctgccaattgagccacatcggcatacgacttatgacttttaactcagcgcattgctgtgctaaaaatgactccaacgggatttgaacccgtgttaccgccgtgaaagggcgatgtcttaaccgcttgaccatggagcctaagaaaaagaaaactccccgagtagggctcgaacctacaacaactcggttaacagccgagtgctctaccattgagctatcgaggattattaaggtttgtaccttcaaaacttcatacaaatccgatttgttttctccgttattaaccagattaagccctcgacctattagtaacagtcagctccacatgttgccatgcttccacctctgccctatctaccttgtagtcttcaaggggtcttactccttataggagggatatctcatcttgaggggggcttcacgcttagatgccttcagcgtttatcccttccagacttggctactctgccatgccgttggtcgacaacagatacaccagtggtccgtccatcccggtcctctcgtactaaggacagctcctctcaaatatcctccgcccgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctactttcgtacctgctccacccgtcggtgtcgcagtcaagctcccttctgcctttgcactcttcaaatggtttccaaccattctgagggaacctttgagcgcctccgataccctttcggaggcgaccgccccagtcaaactccccgcctgacattgtcccattaccagatcatggcaactggttagaaacccagtactacaggggtggtatcccaacagcgactccggacagactggcgtccatccttctccgtctcccacctatcctgtacatgcagtaccgaatcccagtatcaaactggagtaaagctccatggggtctttccgtcctggcgcgggtaaccagcatcttcactggtacttcaatttcaccggatgcattgtcgagacagtgctcaaatcattacgcctttcgtgcgggtcggaacttacccgacaaggaatttcgctaccttaggaccgttatagttacggccgccgtttactggggcttaaattcaaagcttcgcttacgctaacctctcctcttaaccttccagcaccgggcaggcgtcagcccatatacttcacctttcggtttcgcatagacctgtgtttttgctaaacagttgcttgagcctattctctgcggcctgctctcgcaggcaccccttctcccgaagttacggggtcattttgccgaattccttaacaatgcttcttccgccggccttaggattctctcctcatccacctgtgtcggtttacggtacgggcacgcattacacaatagcagcttttctcggcacatggctcacacgcttcactactttatttcgctccacatcacgtcttcggatcatacaacggatttgcctgttgtacacctaccccgcttgtaccggtctttccattcccggctcgtgctttccacatgcgtccctacagttctgataatgcgtggtacaggaatctaaacctgttatccatcgcttacgtcttgcgacctgtgcttaggccccgacttacccagagcagatcagctttactctggaaaccttagatattcggccgaaaggattcccacctttctctcgctactcattccggcattctctcttcttatccctccactgctccttccggtacagcttcgtcggttttaagaatgctcctctaccactcgcattgcgagtccacggcttcggtgtcgtgtttcagccccggacattttcggcgcaggaactctcgactagtgagctgttacgcactctttgaatgtatggctgcttctgagccaacatcctagttgtcttcgaattcccacatccttttccacttaacacgcactttgggaccttagccggtggtctgggctctttcccttttgactgcccaacttatctcgtgcagtctgactcccgatcatcatctacatggcattcggagtttgatattctttggtaagctttgacgcccccgcggaaattcagtgctctacctccataagactaaatcgaggctagccctaaagctatttcgaggagaaccagctatctccgggttcgattggaatttctcccctatccacacctcatgcccacccttttcaacggatgtggcttcggtcctccattgtcttttacgacaacttcaacctggacatggatagatcacccggtttcgggtctgcgtatactgactttacgccctgttaagacttggtatcccttcggctccgcaccttaagtgcttaaccttgccagtatccgcaactcgccggaccgttctacaaaaagtacgcggttgttcatttaaagaacttccacagcttgtaaacacagggtttcaggttctctttcactcccctcccggggtccttttcacctttccttcacagtactatgcgctatcggtcactaagtagtatttaggcttacggggtggtccccgcttattccatcaaggtttctcgtgtctcgatgtactctggattccgctcagtcagctttcctttcgcttacggggctttcaccctctccggcaggctttcccaaacctttctgctagaatcactgaatcttaaatgcggtccgaaccccggagtgcacgcactccggtttggcctctttcgctttcgctcgccgctactaacaaaatcgatgtttctttctcttcctccggctacttagatgtttcagttcaccgggttcccctccatacgttatggattggcgtatggatgatacgagttcttcgtaccgggtttccccattcagacatctgcggatcaaagattatttgcatctccccgcagcttttcgcagcttatcacgtctttcttcggctcttagtgccaaggcatccaccctgcgctcttctttgcttaatctcttcgatgcatagcgtcgcatcattaataacttaaagaactttgttgttgttcacaacttggttttgtttctcggatgtcttgattgttagatattcttaagaatagaatatttattcatcaaatcatttgtatgaagttttcaaggtacaatgtcgattgtaactgttttatcacatcgacgatggagacggagagattcgaactcttgaccccctgcttgcaaggcaggtgctctcccaactgagctacgcccccgttgtaatttggcagccacctactttcccataccgttaccagtatagtatcatcggccgtttaagtcttaaccatcgtgttcgggatgagaacgggtgtttcccaaaaacgcatcgccaccaaaagtttgaacacttagcgaggtattttcgagcttagtgtgaaacttgttcgatttgcgcaagcaaagtcgaacttcctcagcttaccccagtgttatttgttattaaataatcattaataactcaacagtgaaaaactctctactcgatttccttagaaaggaggtgatccagccgcaccttccgatacggctaccttgttacgacttcaccccagttatcgagcctgccttcgacagctccttcctttcggttaggtcactggcttcgggcattcccaactcccatggtgtgacgggcggtgtgtacaagacccgggaacgtattcaccgcagcattctgatctgcgattactagcgattccagcttcgtgtagtcgggttgcagactacagtccgaactgagacgttatttttgagatttgctcggcttcacagctttgcttccctttgtttacgccattgtagcacgtgtgtagcccaagtcataaggggcatgatgatttgacgtcatccccgccttcctccaggttatccctggcagtctctctagagtgcccggccaaaccgctggctactaaagataagggttgcgctcgttgcgggacttaacccaacatctcacgacacgagctgacgacaaccatgcaccacctgtcactcctgctccgaagagaaggtacggttaagtaccggtcagaaggatgtcaagacttggtaaggttcttcgcgttgcttcgaattaaaccacatgctccaccgcttgtgcgggtccccgtcaattcctttgagtttcattcttgcgaacgtactccccaggtggaatacttactgcgtttgcgacggcaccgagaagcaatgcttcccaacacctagtattcatcgtttacggcgtggactaccagggtatctaatcctgtttgctccccacgctttcgagcctcagcgtcagttatcgtccagtaagccgccttcgccactggtgttcctcctaatatctacgcatttcaccgctacactaggaattccgcttacccctccgacactctagtacgacagtttccaatgcagtaccggggttgagccccgggctttcacatcagacttgccgcaccgcctgcgctccctttacacccagtaaatccggataacgcttgcaccatacgtattaccgcggctgctggcacgtatttagccggtgcttcttagtcaggtaccgtcattatcttccctgctgatagagctttacataccgaaatacttcttcgctcacgcggcgtcgctgcatcaggctttcgcccattgtgcaatattccccactgctgcctcccgtaggagtttgggccgtgtctcagtcccaatgtggccggtcaccctctcaggtcggctatggatcgtcgccttggtgggccgttacctcaccaactagctaatccaacgcgggtccatcttataccaccggagtttttcacactgcatcatgcgatgccgtgcgcttatgcggtattagcagccgtttccaactgttatccccctgtacaaggcaggttacccacgcgttactcacccgtccgccactcagtcacaaaataatcagtcccgaaggaaatcaaataaagtgcttcgttcgacttgcatgtgttaagcacgccgccagcgttcatcctgagccaggatcaaactctcatgttaaaagttgatctcagtcaagttaaacttggctaattcgttcattcagatagaatctgaatttactgttttaaaggtcttcaattttcattgaagcgttctgattgattctcaaaatctttcaaggtttctcactgttcagttatcaatgttctttgtttcgctttcttgcaacagcttgattattttatcaaatcgttgttcgtttgtcaagcatttttttattttttgaactctgttttaagttctctgtcttgcgacagcttgtttattctatcaaaatgtttttcatttgtcaagaacttttttattttcttttgcacatctgttttaaggcaaaagaaagcgcagggggtgggattcgaacccacgcgcccttgcggacaaacggttttcaagaccgcctcgttatgaccacttcgatacccctgcgtgtcacaattaatacttaattgtttagttgtctgcacttgttcagcgcaggatttatattatcatcaatgttacaatatgtcaacactaatttctaatttttttacatttttctgcgtttctttaaaaaaagttctgcaatccccatatcttcaggagttgtgacctttatattttcatacgagccctctatgagccttacttttgtgtcactcccatactctactatcattgcatcatccgtaattgccggcacacttttcccatatgacatgtcactaaacagcttatcataggactgagccagcaaatcatattcaaagcattgcggtgtctgaatctgccacaggcttttcctgtcaggagtatttgctgaatatcccaattcatctgacacctttattgtgtcctttacaggcattcctgctacgcatgctttttctttttcaaccgtatgcatagaacgaactattatttcattatccaccagagggcgtgcgccgtcatggatcagcacatagtccgtgccgtttgctgctttaagcccctcatataccgagttgtagcgttctttgcccccctgcactatcgctttcaccttcttaaagccatatttttcaattatcgaatgtctgaaatactcaatataatctgcactgcagactatgactatttcatccaccggactatcctcaaatgcttttatactataataaatcacaggctgccccaaaagctccatatactgctttggcatattacttttcatccggcttcctgtaccggctgacagtatgattgccgtgtatttcttcttatccatattcttttattttcctatccatgataaatctgcacattatgtttgcaccccggtgtaaccggaagcaattacagaatcattcaccaagctttagattcggaaccgcattcagatcaagtccggacctcttacctgctataaaatcatagtatgctgccgcacctatcatagcagcattgtctgtacacagtatcggtgacggacgatagaatttaacacccttgcgcgcgcacatttcctccatcgcatgacggataataccattagaagcaacgcctcccgcaatggcaaatttgtccattttaaactcatctatggcattctcagcgtgtccgacaagcacatctgtaaccgcctgttggaacgatgctgccacgtctgcctggtttatttccagtcccttcatcctgcagccgtttaaataattgagtactgccgatttaagtccgctaaagctgaaatcataaactccgcccacaatctttgctctcggaaactctatgctgtgcgggtcaccctcatgtgaaaccttttctatcttaggaccgcccggatagccaagtcctattgctctcgctaccttgtcaaatgcctctcctgccgcatcatccctcgtgcgtccgaggatctcatatttaccgtaatctaccactctcaccagatgcgtgtgtcctcctgatacgacgagtgccagaaatggtggctctaagtctttattttctatataatttgcgctgatatgtccctctatatggtgcactccgacaagaggaatgtttcttgcgtatgctatagcctttgcttctgccacgcctacaagcagtgctcctacgagccccggaccatatgtcacacctattgcgtctatatcgtcgagtgtcatatgtgcatctgaaagtgcctgctctataacctgattaattttctcaatatgctttctggaagctatctccggtactacccctccatataaagtatgaagagctatctgcgatgaaatcacattacttctcagatcacgtccatttactacaactgccgccgcagtctcgtcgcatgagctttcaattgcaagtattttaatttctttttttgtttctgtattttctgtcattttattacaccaatcttaattatattactctattctgtttccgtatcagaatctgcagcaatcttataaaatgtaagaatcctccaacagccttccttatcctgcctgagtacatattcctgatatgtcttagaatacgagctgccctccttcatgaagtatgatgccttgacatatgcaattttactaccattatcggtgacatattttacatcattgctgtcacacactccggtctgagcaagtgtaacgccctggtccttgtagctttgcgcatctgccgtgacagactgtttgtaggtatcctttggattgtttgctgcaagctcgtcatcaaaaagcttgagcgcctggtcggtgagtgcatcaagctcttcatcgctatactgcataccatagtagcacttcacaatcctgttataaagcttcaccacctcacgaggtgtctgcggatagttcttgtcgagatccttagttgttattctttgtacctcggtcagtaccttttccttttgattagcccttttagacttgtcgtttacgacataaaacgaaccacatatcgcagcaatcagcgctattgttaaaataactatacctgttttcttcatatcgcccctccttagtcctcgtcaaacatgagctccacactctttgcatcttttccaagatatgcgtttgcaaaaatatccctcacctgtggcatataatcctctgcacggacaagtgacggcgaaaaatgtgtaagccacagctccttcacgccggctctctttgccatgtctgctgcctcataaaaggtcatatgcttatactgctttgcttttactatcttttccttttcagcatacatgccctcgcagataaaaaggtctgatccctctgcagcctccactatgtgctcaagtggccttgagtccgtacaatatgtgacctttatgccctttcttgccggtccaagcaccatatccggagtatacactctgccctcaaattcaacggtattgcctttctgaagaggattccacaggcgcatcggaatttctttttcctttgctctttccacggaaaatctgccactacgctttatctcaaccgaatagccatagcacagcaccgcatgctttacgcggaatgcatgtatatgatatccgttcatctcaaaatattcatcctgctcattgagctctatgcattttatctcaaaaggcagctccggcgcaatcgtccgaagtgcagtgacaacccttgtaagccccttaggtccaataatggtaagcggctcggtgcgctcggcatttcccattgtaagaagaagccccggcaatccgctgatatggtctgcatgaaagtgggtgatgcataaaatatctatcggcttgaaattgattccggcctccttcatcgcaatctgcgttccctcaccgcaatcaataagtatattgctgccgttatattttagtgaaagtgccgtaagccatctgtttggcaaaggcatcatgcctgctgttccaagtaaacacacgtctaacataaattttcctccgcagtataggacatgatgacaccgtcctctaccggatgctcatatagattttttctgattccaaggtttacaaaccccatcttctgatacagtgatatcgcagcctcattagtcaccctggcttcgagcacaatgcgctcaacacctgactcttttgccttttcctgcaagcatctgataagatgtgcacccacaccttttcctcgtgctgattttttgactgctatattggtcagctctccctcatcaaatgacacatacgtgcactgataccccagtatctcgccatcctcctgtgccacaagcatgatattctccggaagccgcatggcatccaaaaatccctgtctgctccagggctgtgtgaagctgtctttttctatctgcgccaccgagtctgcatcctccggctccatgggtcttattatcatattctaaaatctctctccttttcctgtctctctctctccgcctgtgataatctgagatactcaggcttatggtctgctgcattttctgccctgccctgctcatagagcacctgtccaagacatgctacagccgaagctctttgcttattgcacatggcaggcgcaaagtcatagtccacctttacgtgctcattgatataatccctgaacacatccactccgtctccaaggaaaatcaccctgcggccgagctcattgatttggtcaactatctcttctatcatcactacgcactgcggcaaaatggtattcatcctgccatcagtaaaatcatacagccctgtataggtctgctgtcttcttgcatccataagcggacacacaacatctgcactgccccacagattgtatgcaagcgcatctacagtaggcacagaaactatctgcttatccagtgccagtgcaagccccttcgccgtcgcagagcctatgcgaagccctgtaaacgatccaggtcctgctgagactgcaataaaatctattgtcttaaggtcaagctctgtcatcttagccacctcatcaagcatcggaagaagtgtctgcgaatgtgtctttttataatttatcgtgtattctcctatcagattatcgtccgatacgacagccacactggccacaagccctgagctgtcaagcgcaagtatcttcattataaaacctcttttattgttatttttctatagtcaaagcctttttccaggtctttttcaatagtaatctcttttctcttctttgggagtatctcctcaatgagatttgcccactctatcatcgtaagcccatctccgtagaaataatcctcatagcctatttcatccatctcctcgatgtcaccaatcctgtatacatcgaaatgataaaacggaagcctcccctcctcgtacacctgcactatggtaaatgtagggctgtttatcggctctgtgatgccaagcccctctgctatgccctgcgtgagcactgttttacccactcctaaatcacccacaagtgtacacacatcccccggctttgcctgctgtccaagcgtaaccccaagtgcatgcgtatcatctgccgaaaagctttctattactgttatatttccttcactactcatattaccagcttatacccttatctatttattttatcttatatctattttgtttatttgattttcagtctgtatttctccagtgtactgcctgccagctcctttaacggctcatagctgtcgcccagctgctcctttgagagaatgtatgcattcttcctgttgctgaatataagtatcctcttatcatttgccacgaatctgtacacctgctcccacggaagctgcgccatctcctctccctggcttacttttatgttcttttcatctatctcaaaatgcagtggctttgagaaaacttcatttgtcttcataatcatctttaccctgcccttgagtgaaaacggcacatatagcagcaccagaataccaactataatataaagcaccacatactccgtattgcctttttgtgcgcttaacactgctgccgcagccaagagcacagcaaacagcaatgatatgacaccctgactgcccttgtacgcctgctctatattaaatgaatataaatctttttctgttacttttacatcaaattcaagcttcatgtcctgctcccaactaaatatttggatttattataacattccttttaaaaaaagaaaagagcgcaattgactgcgctctttatgtttgtgactaatatatattgtgtcaggtattttctctatcctctgccctttaaaaccggtgacagtctcttgtatataagcactgtgataagtgttgatataagtccctttacgatggtaaacggaacattgaatattaaaagcgcctgccacagcttgcctactgatgggagaagctcactgtaggcaccaatgattgcttccattggcatgaactttgtgtatgccggatacacgataaacaggttcgacgggaagctgacgattcccattaccactgaaccgactacagcgccgattattgcacccttttttgacttattcttcttgtagataagtcctgctgttgctgtaaatactgctccaagaataaagtttgaaagctctcctaccgtaaagctctgtgttactgtacaatgaagcaggttcttgataaactctacaatcactcctgctaacggtccatatgcaaatgcgccgataagtgcaggcagatctgagaaatcaaacttaataaagcccggcatgattggaattggaaactcgaggtactgaagtacaaatgcaagtccgcttaacattcctgtgccgactaaaagtctgatgtttacttttgattttgtgttgtttgttgttacgtccattttacactcctttgatgcttaaggaatcctgaggatattgtgagtgcagctatctaaaatctgaatagcggctttaaaaaatcccggaagaaaatcttccgggacttaatatcacagtgtaatgacacctaataatcttctctcatccagactatactgtcggcttcggaatcacaccgaatcatgccttgcggctcgtgggctgtaccaccggtagggaatcgcaccctgccctgaagaattcctatttatttacaaacctatgatatgcactttgaagtgttttgtcaaggtatttttaattatcaagaataatattgtcaaagaaattatttttcttgccctttatgtagtgtggctttttgtttctgttgttattattcttgctgcctgtactatttctatcgtttctgctattcttgccgccgttatttctattacttctgtcagccttgttggcaacactgtctttgccgctgtgttctgacttaccggccttgtctgtgccctgtccgattttcatggtaagctggatgcgccgctttttgaggtcaacgctcataacctgcacatctactatgtctcctacactgacagcctcaagcgggtgcttgatatagcggtcacatatctctgagatatgcacaagtccgtcctggtgtactcctatatccacaaagcatccgaaatctattacgtttctgactgtgccctttaataccatacccggtgtgaggtccttcatctcaaggacatcgcttcttagaattggctttggcatatcctcacgcgggtctcttgccggcttttcaagctcttttacgatgtcacgcagtgtgatttcaccaactcctgcctcgtctgcgagcgccttgtaatcagataccttctttgagattccaactacatttctgttctttacatcctccattgtgtagccgagcttttcaagcactgcctttgtggcatcatatgactcaggatgcacgcctgtggcatcaagcgggttctttccgtctgagatacgcatgaagcctgcacactgttcaaatgccttcggtccaagctttgctaccttaagaagctgtgaacgtgatgtgaatttaccgttttcctctctgtagtccacaatatttttggcaatggtctttgagatgcctgatatgtactcaagcagtgaaactgatgctgtatttaaatctacaccaaccttatttacgcagtcctctacaactcctccgagtgcctctgagagctttttctggttcatatcgtgctgatactgtccgactccgattgactttggatcaatctttacaagctcagcgagcggatcctgaagtctacgcgccatggatgtggcacttctttgtcccacatcaaaattcggaaactcctccgtggcaagcttgctggctgaatatactgacgcacctgcttcatttactatgatgtactgcacctttaccggaatttcctttaacagctcgacaatcacctgctctgactcacgcgatgctgttccgtttccgagtgagataagagtgacatgatgcttgtctatgagctttttgattacggcctttgcctcctcgaccttgttctgtggtgctgtcgggtagattactgtggtatcgagcacctttcctgtagggtctacgacagaaatcttgcagcctgtacggaatgccggatcccatccaagtacaacctgtcctgcaattggaggctgcatgagaagctgctccaagttctttccgaatacctttatggcaccatcctctgcttcctctgtcagattgtttctgatttcacgctctatggcaggggcaataagcctgtcgtacgcatcctccactacctctgtgagtacggctgctgtaggcgctccatcatttgtgataacctgctttttaagatattttatgatatcctctgtcggtgcctctatctttactgtgaggattttttccttctcaccacggttaattgcgagtgttctgtgacctgccaccttggaaagagcctcatcaaattcatagtacatctcatagacagactctgcctttggatccttggctgtcgatataagacgccccttttgcatggtaagctctctgatttttgttctgtaaccggcattgtcggatacgttctctgcaatgatatcctttgctccggcaagtgcagccgcttcatctgccacgtctttttctgcatccacatatttagctgcttctgccatgatatcaacagacgattcctgcgctaaaatggtctgtgccagtggctctaagcccttttcctttgcgattgtagcacgggttcttctcttcggacggtaaggtctgtacaaatcgtcaaccgccacctgtgtctgtgcctcaaggattgccttcttaagctcatccgtaagcttgccctgctcctcaatgcttgcaagcactgtctgcttcttgtcctcaagattacgtagatatgtcagtctgtcgaagagatttctgagcacctcatcatttaatgagccggttgcctcctttcggtatctggcgataaaaggaatggtgtttccctcatctatcagcttgacagcggcctcggcctgtccttttttaatctgcagttcttctgcaattgcagcaataatatccatttttttacctctttaaaaaacttattcttttcgtattataaatgaagtgatacaataaaatcaactttatagaaaggaattttattatggatccacaaaaatttgattataatcaggattataactataatttcggcagcaattatgggccgggctttaatcccaacaacaatttccacaataaacgctcacgcaatatggaggttgcagcacttgtgctttcaataattgccatcgcgtcgtgcagctgtatttatgtgtctatcatatgcggctcgcttgccatgatttttgcgttactgtcaaaaggcggtgccacctcaatgagcagcatggctatgacctcattctggattgcgtttgccgctgttgttatcactcttattatctatatcggttcgtttgccgccatgcttcacgaatatggaagcatagagggtatattaaaggaataccagaacctgaccggtatcgactacaatgagctacttaagcagatgaataccgcaaaataatataagcatatttttgactatacagtttaccacaataatggcaagtgcaagccacatatataatggcctgaagtgcattccgatgtgcagcctgccgcggcttatccgctgcagtgtctgtgacagcataaaccagcctccaaaaacggctgtatacggcacaaacggatggagtacaaacgaccttatcagatgtccgtgcagcagcgcaaatgtggctctcgtaccaccgcaccccggacaatagtagcctgtatatgcgtgcagcggacatggaggcacttttgtgagtatctgcgtaccgcatactccaatcactgccgcaagagccgcaaatacagctatgcatatccagcccgttatatagaaatacctgtcgattgtttcatctgtctgcatgatatgtgtggtccttcctgtgattttgtgtaaccatatgaatacaagtatatgctatatatctgacaattgtcaaagcattaatttaaacattaacttaagcattaattcaaaactattatttcaggagaaatataatgaacccaaaaaagaaatccaaagaattaaaaagaatatcaagagaaaacctgaacggaagatacagacttagcatgagcgtttttctcactgtcacactcataaatctgtttagtgacctgccgtttacctatctgctcggaaatgtatatgccacaaaagttcagaccgtcatctactacattgccgaggtgcttttatctatcgtggtcggcgtgctgcagatgggactcatacgtttccaccttaatatggcaagaaagaaagagtgccgtatcagcgatgtattctactgctttatgaatcactccaacagatattttggagcatacatcatatattatgccatctctatgattgcaaaggcgcctttccttgtagccagaaactttttcaagctaagcggcgacactatgggaattgctatcgctttatatgctgcaagtgccgtgctcagctttatcgtactggttctgtttccgttttacctgtatctggtgctctctcgcgatgatttatcagtatttgcatgtctgactcatgcaataaaactgattcgcggcaacatactcagagtcatctacattaacgtaagcttcatcggtatgcttgtgctttgcgtgttgtcgctcggcatcggcctgctctgggtggagccttactatgagcagacctttacaaatctcttcctcgatgtgaccggggagctgccggctgtggactgcgcggtgtaacggcttatataatcgcttgtgcatggagcgcttcgaattcaggttatgtaagtgcatgaagcgcccggtgcacagattatatatcactccgctctcataactccttagtctagtgggagtaaatgccgtcatccgcagagcttatcagacgcggaaaatcaaacgcgcattttacctcaatatctaaattcaggctatgctgcttgaacgagtattttccgcgccgcttttgctgatgacggcatataactcccacacgacacgtcgtaaatcgaacgtagcgacatacaatctgtgcaccgggcgttccatgcactaatatacttcttctatttatcttactgctccatgcacttactcaacttttatcgaaatttccgaacatgtgggatatataatccgcatcccacccgctccacgcacccactctcaacctaaaatcgaatctctacatctttagcaaccggtccataatccttgctgcaacgcagctcttgtccatgatttcaagctctgtgcagtcgtcagccgtgatgagtgtgaccacattggtatctgttccaaagcctgcgcctgctacctttaggttatttgccactatcatatctgcatttttctttgcaagctttgctttcgagttttcaagcatattctgggtttccatagaaaaaccgcatatgagctgtcccttagccttgtgtgctccgaggtatgaaaggatgtcctctgtgcgctcaagctcaattacagacttatatgagctgtcatttttctttattttctcatcagccggatgtgacggacaaaaatccgctactgctgcggtcatgatgataatatcctgttcaacagcctttgatttcaccacatccgccatgtctgcggccgatgtcacatttaccacatctacaaacataggtggctcaaccgatactgaagcgttgaccagtgtaacatgcgcaccgcggagcatacagttttctgctatggcacgccccatcttgcctgttgagtgattggtgataaaacgtaccgggtctattttttcctgcgtcgctccggctgtgatgagtacgtttttgccagccaggtccttttcacaggctattgtcctcattatgtagttgaaaagtgtctgtggctccggcatttttcctgcaccggtgtctccgcatgcaagatatccttcagccggctttatcatctcaaaaccgtagtgttcgagctttttgatattgtcctgcacaatcctgttctcgtacatattggtgttcatggcaggagaaacaagcttaggacatttggctgcaagtattgtggtggtaagcatatcgtctgcgattccatttgccatcttgcctatcacattggctgatgcaggtgccaccataaagatgtctgctctctttgcgagcgccacatgctctacattgaattcaaagtttctgtcaaatgtgtccacgaggcacttgttgcctgtgagagtttcaaatgtgattggatttataaaatttgttgcattgtgtgtcattatgacgttgacatcggcgtgctgttttacaagcatactcgcaaggtttgctatcttgtatgccgctatacttcctgtcactcccaaaactactgtttttccttttaacatgattttcacctctgtataaaactattattattctgcagtcattttttgtttacatcgcaaaatgctttgtagccatccacagactttgcacttctagctgcattggcaatggcctttgccatgacataggcactcattggccccaccagattgatatctgcaggcacactgcccactgatacagcatagattgaatctccgtctgccatcgtgtgcacgggtctgattgctctgccatagccattgtgagccatggatgccaccttgttgagtgcggtcttgtcaagctttgcatttgttattattgtaccaattgtggtgtttcctgtaaacatattctgaatcttcgccgctgcctcaaaatacgctgtctcgtcatcaaaaagcagcccattttcatccagtgctccggcaattttcttatctgtatctatatcatatatgtcaccaagtgcgttcagtgtcaccactgctccaacctttagttctccaagctgtactgcataggctcctattccgctcttcatgctacgctcacgccccatatatttgccgactgttgcgcccattccggctccataatttccctgtaaaaaggtatcataagaagcgttctcacaagccttgtatgccattttgccatcaggccttgcatttttatcacctattaccaggtcaaaaatgcacgactgcaccacaagaggcacctttgtgactcccacatcaaagcctatatcacgctcctcgagatacttcatcacgcctcccgctgcatccagaccaaaggcagagccgcctgacagtacaagagcatgaataccctttgcgtctgccacaggatttaaaagtggtgtctcccgcgaagccggtccgcctccccttatgtcaactcccgccggtgactgtttatcaaaaagaaataccgtacagccggtcaatcccttagtgtcctcggcttggcctattttgaagccgccgatatccattatgtctatttcatgcatatgtttcaccttgtatcatgcctttcttttaactcaaatgctttttaccattcctagtccaactgcttataaaacaggcggaccttatcagtccgccgtacatacaatttcacatttattttaaatctatctgaatttattttgctgcaattggtttgatagtatttaaaaccaatccaacaaggtatacgatgattgcggcaactattgcctcaattactccgttaaagctgatgactccggtgataacacccagcaccgcgtttcctgccacaccgattgcatctgcataagcatccttgtaaagcacgaagattgagcccattacaagcagtgtattggtcatggcaccggctacacctgcatatacaaacggaataacctgtgtgctctttctgataaatacagcctcaactactataaatactacagctccgactgctatgccgattcctaaagcggctgcctgtgaaagtgactctgacatcttgccgaggaatgcatatactccgaatgcaaggaatgctgacatgagcacatttaaaactgtgccccagagatttttcttctctgacgcaagcacctttttgatgcctatatatacaaaataaggtataacacctactaaaattcttggaacaaatgctatgaataagctcttaaatatacctgaggttccgaccagggatgcggcaagcaccggcgaaaatacaaaggatgaaagagttcctccgactatagttgcctttaaacaactggtaaatccgaatacaaatccaaggaatgctccctttttaggtccgcagaaaagtgaaccaaggattaccggaatgtgaataatcgtagcgttgataactacgagcggaatatatccgagtggtgtgaatgccatgataatgataatggctgtgaataaacctgtcagtacaagttcgtttgtttttgaattgcgcattgtttttcctccttttggtaaaagcccatatgggtctcgtcctaattctgttatgctgtgattctgtcacacggcataagagcgcacatgaaaattgtatggctgctggattctcgtatgagtaacccgcatttatgtatcataccaccgtgcaagaaatgtgtaaagcagtttttgttatttttttaacaattttttaataaaatgtgttggtgcagtgcgaatcaccgacatatacatctatgtcttacatatgctgcattgtatctcacaagcgtgaaaaaaaatccccggacatcgtataaatgtccggggaaattatttattctactgtaactgattttgcaaggttacgtggctggtcagggtttaagccctttcctgttgatgtgtagtaagcgataagctgacagattataactgactcgaaaatcacaaactcatccggtgcctgtgggagtgagatatgcacatcacagattgacttatctgtaatatccttgtccttgctaagaaggataacgtatgcgcctctcgcctttacctcgcggatatttgagatgaccttgctgtatacatggctctgtgtagcaactgcaataaccggaaccccctcgctgatgagcgcgattgtaccgtgctttaactcgcctgctgcataagcctcagcatgaatatatgaaatctctttgagcttgagtgcgccctccatgcttaatgcataatcaagtcctcgtcctatgtaaaacgcatttgcagcatttgtcattctcttcgtaagctgttcaatctcaggtgcctgtgtgataactgactcaatgagatttggaacctcctgcagattctcaataaatgtctttgcctcttccttggtcatacggccggatacaagaccaagcttgcatccgatcaggtaaaagcttgccacctgaaccgtgtatgcctttgtacttgcaacagcaatctcaggacctgcgtgtgtataaagtacatagttgctctcacgggctattgttgagccctttacatttacgatagaaagcgtctttttagtatacttattagccagacgaagtgcctctaaggtatcgattgtctcacctgactgtgacacaaaaataaccattgacctgtctgtgagaacaggctgctcatatctgaactctgatgcaatctcaacagaaacgggaataccaaacttgttctttaaaagagcttttccgaccattccagcatacatggctgtaccgcatgctacaactgttatgtcgcttatatcctcgaagaacgaatccgggatattatcatcctcaaaacaaggaagtgaatccttgattcttggagtgatagtccttgtgatagctgttggctgctcatgaatttccttgatcatgaaatgcggatatccatccttctgagctgccgtcacatcccagtttacctcaagataatccggctcaactttcttaccctctaaatcctccatttcgattccatcagcagtcattgtcatgatagtgtactccggaagtataaaatagcgctttgaatatttgataaacgctgtaagatctgatgcaataaatgctccgtcatcgcaatatgttgcaaccatcgggcttacatttctgacagcaaaaatctttcccggctgatccttgaacatgatacagaacgcaaatgaaccctgaagctctgctactgccttcttaatagtagcctttggatctccgtcatagagcttgttgataagagccgctgctacctctgtatctgtctcagatataagagagtctgcaagatcaaacttgtttacgatctcatggtaattctcaatgataccattgtggatgagtgcgacatttccaaccttgtgaggatgagcattggcattggtaactccgccgtgtgttgcccatcttgtatgtccgattccacaggttgaattgttctcatcatcgcagatagcgagaagatccttaacctttccgacggttttgcgaatagaaatcttgcctgtatccttgaaataagcaatacctgcactgtcgtatccacgatactctaacgctgcgagtccttccgtcaaaatcttctgagcctctaaacggcccgtaaatcctataattccacacatagtgttagatctccttttcgatatataattttaaatgtacaaatatgtaactgttctgtactgaatagctacttgatttttatggttctctcgctttgttttgatgtctccatcatatttggctcgagatacgcatccatatatgcgtccaggcatccgccgaattttcgataacctgaaacctcgttaaccggcatcattttttacgtacctgccggtgcatggcgctaaagtttttaacttttcgaaatccaattcctccacatttgattgaacgttgttattctatcacattgggataaatgcctcaattgtaaaattagctgaatttttcataaatgtgtgggtaaatttataatatgcgactatattttgttttataacaaaatatagtcatcaacagcttcatgaaagccttctacaagctctctggcattttcaccttcatatgatattaatgaacgtattcccataacttttccatagaagattacatcctcctctgaaaactcaacacttccaacatagcctttatattccatagtattatttatattgaccaccctaatatttcaacagcatcctttaattcaatacgtatttcctcatttggtacaaacgcactttgagtattttgatcgtaccacaaatatcccgaatgaataagatacgtgagtacatcatctttgtttgtaaagcttattatgtttaattctcattattacaaatgcacccaatttccatcaccgtctacaaaatcatccccccaactgcgataggctccactcatatctttgtaggtatttccccaactaatataatttccatcataatcataaaatgagtctccccatctacaccagtttccttgacagtcaacaaagctatctccccattttcggtatgctcctgatgcatctacaaatgttattcttttccttttatcctcagagtaagaaccccaaaaatagtttgtattattatcattagaataattagtatattcatcataatctattccctgtcgaattttcgaagaatccctactagctaatcctgaaataattggtataaatacacataatgctgatataatgcaacatattattaatagaacaatattattactttctgcccaatcggcaaacgaactatatccaaatatttgtaaaataaaacaaacaaaatatacaaactgttgcaaaatcacccccataacaaaagagccaataaataaaagaattattccacaaactatcaaaataaataagccaataataataatcgcctccataattagttaaaattccccatctatatgtttatctgacattaactatagatatctactttcttattttcatcatttgcccaattttctaaaactttaattattaaattattaacattctgaatttggcgatttattctaggattctgtttttccttaagtaaaattacctttttagcacaaagcttatttttttcaattatactattcaattcactgtttacttcagtatctaacgttgggacgtataatacatatatagcaaaagcaacctgtttattatttatcttttctgctgtgacaaaatatgttatccaagaataaacattttttgtttgttcatcaccatcagctgtaataaatattgtatccatagcttcagaatagttatctattgtccttgacatacctaaacgaacagaaaaacattttccataattatctataaactcattaaccattaactgttttatcgtttcaacatccaaattatttgtatctatagttacctccttattccattcttgaacaacaattggatattgcactactctattttgaagcgaaagattttcacaatattcctcaatcttctcactattccaattaacacttctatattcatattttatactattatcttctataaaattatttggttgtgaatcattatcaacaaaattatttaacttatattttccttcctgtaaaaaaacaagtctatcttcttgttcataatttctaggaatataattcttgaccatattttccaatattttcttttctaaatcatacgcaccataaaatgcaaacactttttgtaaaatattaaattgagaaccatctattttaaacagcttacaagtgtactccaaaaagttatcgagcattttatcgagctcagtaaatgatttagtatacgagttccttatagtctccgcaataatttcatcaactgttataacatgtactttttcctgttcacaatcttctatgaataagaacactttcttatataaattcttaactgccttatatttctttgtttcctcatcactaattccttctacctttgaagctataatcaatgcttttttgagattaatcagtgcactctcgtccacatccacaaacaacagggtctcaagggtcttccaaatgtcactatcattatagtagttttctatattgtcaattgaattaattaattcctctgatatataatcgtaagcattttcatcaaaaaattgtataatttcatcaattgcattttcttcatctaacacactatttattgcatcgtgtgatttcacaaaataatcataatgcctcaagtactttgaatattcatctttgagagcagtaatagtatatagatcatgaacatgtctgtataaacgctcatatccccaatttcccttcatatattgttcaaccacaataggcggatatttaaatttttttaaagtataccacgcttcataaacaccactctctaatacttctttaggtaaattatctaattctgaataatccctatatccaatgggtgattctttctctatagaaaccaatgcctcattcattttattagccatttgaatcatgtgcctatttttttcctcttgttcttgatccacttcccaaagcaattttccttgaaataatccccatttaagatgacaaaatatccgatgattaaattgatcttgaggtataatgtatttatcgctatacagtttacttcctgctgtgtcaccatatctcatataaaattcatgttgtgaataatcaagaggtatacttatttcagcaccattttttaatttagcaacccattttccatcaatatttatatctatcggcgctaaagaaccactaaatctattctctctttttaaaatcaattctctatagctcatcttcttattctcctatctactttttaataaaatttgtgtattttttctcaatttttgtatactctcattcatatgcctataaaattcagcatcagattcttcaatgtccattgcaagtttcatggtattattatatttatttatgactctatttaaattctcaagacatttctcaagcccaagctgatcctttacaatcttatttgccaacacttcatattcttctattgcttcaaccatttttaacttagtacaatcattttgtaattgttcaaaaaccaccactgctatacgccattcttttatccatttagtcttgtttttctccactctaatagaaaaagtttcttttgatatgtgcctttgtaattttctgactgacattaaatcatataatttatctgttgttggagcatctttcaaatcaaattctgtaatctttaatttaaacggtcgaagcaaaccttcgtatgaaattaacgcatctcctggcatatacgttgctatcgactcaatctgatttccatttgctgacatcatagatcctacaatttccctatcatcttgagctgtaagtctatgaactattttcagtcctgtattttttaacacctctggtgccattgctgtcggaagctgatctgcaatgataataccttctcttaaagctctaacttctgccagcatcttcacaatataattagtcgctgccaccttggggtttgcatccccagcaacgctttctccagtggcatttgcaattaaattatgtgcctcttcaatgaaaatcacatgccgaacggccctcatatcatcacctttaggattagcttttagaacctctctaatcaatgtacaaatcataagtgtcataaaattcgatggacctgttcctagagattccatttcaacaattattggatattcaaccaactcttctggtctaagacttgaaacgctcacatcaaacacatttcctaaatctcgtctgagtaaccctcctattctcatttctagagcagatttcatatttcctcgtacttctccatcatagtctgtatgtttcaactcatactccaatcttgaatatagctctgaaatagtaggatattccttttttccatcatttacatcatctgtatcccatccatgaaccctgtatatcccctcaatcgctctgtctaataatgcaggtaacggaggtgttaatggaaatgctccctcaaacacatccatcaggttctgtatatgttctgccaatgataatcctttcggaaattcaaaaggatttatagccatcggaaactttgaaccagacgatggtgaaaaaacaattaaatcatctatatcagtctgagctaatgctctatattcttttttcgctggttccaacactaaaaatggaacattacattttttccataatgtataacataaatgaagcatagtatttgttttaccggctccgggtaccccacatacaaatgcatgtttttttagtaaatttaaaggtacacttatttcctgtgtattttttccgagaattatatcaccaccaaatttttttggttctgtttctttttgaatttctatatgttctccatcgtataacataggaaatctaaaaaaatcttttatctcatctaatgtataatatgttggccaatatttgagtgttttaggcattacattacttaattcctcatattcatccagcacatgaaatgttccatttttcacaataacattttcccagtttcccttttctattgtttccccacatacagtgttaaatagaatgtttccaacaattgtatcatttgtataaatcattacatttgccttaaaacatggtgaacttgacaccgatttaagaaacttctcatacgatcgtaaaatctcactggaaaaagcatctttattattagattcccgttgataatccgtcaattttataatattggattcatcattatttgatttattctttaaatactcaataggcttttctaatgaactataaacatcttcgtaagaatcgacacctttaagcacgactctatatactgcctccgtgtttaaattttccattgttttatataaatccatcaatctagagtttttgttgctttcccatgtttccacataaaataagtcaattttttcatcattaccaatatcactgcttctttttctctcacacttttttaaatgtattttttcattaaaagtttcattctgaaatggtatatagtctattggttcaattttatatgcatcggatagttgcgatgctttcattaaattatttaaataatcaatcagttgcgtattttcatatttaaaaacaatgtataattccaatttatctttatcgcaattctcaggactatacttgacaataaaattaatctcgatgtcataaattgctgatattttttgccattgtcttaaaaaatcatctgtccattctcttaatacgtcaattccatttcctgacataatcttatatttcaccaatgaaatatccggtatactcgttaacttataaaccatcatcatgattgctgtcctcgtttatctgtttcccattaatctgtttctacttaaaatcaaatcatcctgatactgctgtgtttcctgcctcaaatccacaatctgttctgcttgatctaatacttcatccccttttgtttccgcaaaacttccaataatgggtattcctcttaaatcttttaatctgtttcccttttcttttaaatcaccacttaccgcatctgccatatccattacttcatcagcgtctctttgtatatcatttgcttcagactctaatttttcactttcatcttttaaatcatttctggcattttctatcgctgcatcaacctgtctctgtatttcctctggtaaatctgtgggaattcttgaaataccttcttctacctcatctcttttttctataaactggtcagttctttctttattgtccatagctttaatcgccacatcatttttcttttctataatccattttctatcattttcaaatcccatctttttccttctccaatctactcactgcattattctcttctaatacatatttcctatattcttatgaaataattatagtacagatatttactaaattcaatagtaaacatctttattatgttaagttatatgtacatgtacggagggggaatatgaattacattcaacgaatgcgcaatctacgggaagatagcgataaaacccaacagcaaatagcagattatctgggtacatcccagaccatgtatgccagatatgagcgcggagcaaatgaactaccgattcaccatctgctcgctttatgtaaatactataatgtgtccgctgactatatattaggtctttctaatatcaaacaaacttccaaataaaacatctgagtcaaatcctttgcgatttacacacggatgtttttttattaagaaaattacttatttccccaaaaaactctttatatttataagattacgctatatttatggtcaaaaaaacacagcactgcgataaacagtactgtgtttaaatgtattagtaatgtaattttattgcattattatgcgattatgcgtcagcatttgcctctttaagagctgctgtaagctgaggaacgatcttctttaaatctcctactaagccgtaatcagctacatcgaagattggagcatcctcgtccttgttgatggcgatgatgagatcagactcctccatacctgctacgtgctggatggctcctgagataccgattgcgaagtaaatctgtggacgtacagtctttcctgtctgtcctacctgataatcctgtgctaaccagccgttctctactgctgcacgagagcatgataccataccacccttgaagcatgaagcaaggtcacgaagcatctcgaagttctcagcgcttccaactccacgtccacctgatacaagtaccttagcgtccatgatgttctctacgttaccaactgccttaacgatatccatgatctcaacataacggttgttctcctcgagtgcaggattgaactcgataacctctgctgctctgccagcctctttaggaagcttctgcataacaccaggacgaactgttgccatctgtggacggttgtcaggacaagcgattgttgcgattgtgtttccaccgaatgcaggacgtgtcatgagaagctggttgtgcttctgctcctgtccaggcatagcattgattgggaaatcaccaatctcaagctttgtacagtcagctgtaagacctgtcttaactcttgctgaaactgttggtccgaggtcacgtccgatagctgttgcaccaactaacatgatctccggcttgtactcgttgattactgatacaagagcctgtgcgtatggctctgttctgtatgtctcaagtgcaggattgtctacaacgattaccttgtctgcgccgtactcaccgagctctgttgcaagagcctttacgttagatccaagaagtactgcagtaacctctgtatttaaatctgctgctaactctttagctttaccgactaactcaaaggcgatgtcgctaagcttattgtctacctgctgtgcgtagatatatacgcccttatattcttctaaacccatttttggttcctccatactagatgatatgtttctctttgaatttctccatgagatagtttactgactctgttggatcaaggttaaccttttctccagctcccttaggtaccttgtcagatgccttagcaatctttgtaggtgatcccttaagtccaagatctgaatcgtcaacatccttaaggtcagctctgccccagacagttacctctttgtcaaatgcatcgaagattccgcccggtgtcatatatctaggctcatttaactctgaaagagctgtgataagacaaggcatcttagccttaactacgtgatatctgtcctcgtactgacgcttaacgactacagaatctccctcaaccttgatatcctctgcgtatgagattacaggaagtccaagatgaactgcgatctgtggtccaacctgtgctgtatctccatcgatagcctgacggcctgtgatgattaaatcataatcgagatttcttaatgcacctgcaattgtagtagatgtagcccatgtatcagctccaccaagtactctgtctgttactaaaactgcatcatcagcgcccatagccattgcctcacgaaggattgcatcagcctttggaagtcccattgtaagaactgtaacctttgcgcctgtctcgtctttgattctaagtgctgcctcaagaccagccttgtcatctggattcatgattgcaagcattgaagctctatcaagtgttccgtcaggattgaattttactccaccctttgtatcaggaacctgtttaatacatactacgatattcatgtatttgttctcctttatttattctaagtagctctacagttatgatagctctcttaactatctgagtaatgagcctgaaataaccatacgctgaacctctgaagttccctcgtagatctctgtaatcttagcatcacgcatcatacgctctacatcgtactcacggatatatccgtatccaccgaataactgaacgcactctgttgtaacagccatagctgtctctgctgcgaataatttagcctttgctgcatctactgagtaagaaaccttagggttcttagcaaactctgccttcttcatagctgctgcgtatacaagatacttagctgcatcgatacgtgtagccatatctgcaagcttgaactgtgtattctgctgctgtgcgattgaacggccgaactgctttctttcctttgtgtactcgatagttctctctaatgcgccctctgcaataccaagtgcctgagcagcgattccgatacgtccaccatcaagtgtatgcatagcgattgggaaacctcttccctcttttccaagtaatgcatcctttggaatacgtgcatcctcgaagataagctcgtatgtagatgatccgcggatacccatcttcttctcttttgttccgaatgagaatccaggtgttcccttgtctacaatgaatgcagagaagttcttcttcttgcgtccacgcttgtcctctgtgatgcttgtaatagcgatgatgatgtaaacatcagcaaccttaccgtttgtgatgaagcacttagatccgttaagaacccactcgtctccgtctaaaacggcctttgtctgacatccctgtgcatctgtaccagcgcccggctcagtaagaccgaaagcaccgatcttcttgcctgaagcaaggtcaggaacatattttttcttctgctcctctgtaccgaatgtcataataggatcgatacaaagtgatgtatgagcagatacaataacgcctgttgtaccacaaacctttgataattcttctacacacataacgtatgtaagtggatcacagccctgtccgccgtactcctttggtacaggaatgcccatgaatccatattttcccatcttagcaactgtctctgctgggaatacctctgtctcgtcagtctcctgtgcaagaggtttaacttctgtctctgcgaactgtttgaaaaggtcgcgagccatctcatgtttctgatctaaagtgaaatccatgatttattctccttgatttttgttttgttattgaattcttatataactttatagtttatatataagctacataagacctatattttataacgtatatatgttatataaagcctactgtgcgtctacaggtgtctttgtgcggtctgcgttgtaaacgtagaatcccttgccgctcttgcatccaaggtttccgcctcttaccatcttgcgaaggagtgggcatgcacgatacttgctgtcacctgtctcattgtaaagaacgtccatgattgcaaggcagatatcaagtccgatgaaatctccaagctctaatggtcccattggatggttagcaccaagcttcatagctgcatcgattccggcgatatctgaaacgccctccatcttgatgaaagcagcctcgttgatcattgggataaggatacggtttactacgaaaccggcagcctcgttaacctgtacaggtgtcttgccgatctcctctgcaatcttcttgattgcatcaactgtctcaacaggtgtgttaacacctgcgataacctctactaacttcatacggtcagcagggttgaagaagtgcataccgattaatggacgtgtaagtccgtttccaatctctgtgattgaaagtgatgatgtatttgaagcgaaaatacactccggcttagcaatcttgtctaactcagcgaatgtagttttcttaacctgcatatcctcgaaagcagcctcaacgatgaggtcacaatccttgcagagatcttcttttaaaccaggagtgatgcttgcaagaatgccgtcaaccttctcctgtgtcattttctcttttgctacaagtcttgcatatccttttgcaatcttgtcttttccgccttcagcccactcctgcttaatatcgcagagtgctacctcgtatccatctacctgcgcgaatgcttttgcgattccctggcccattgtaccagcaccgataactccaaccttcattttaattcctcctaaaatatattatggtgcaaaagctttaagtgctaagcctctgcagcataacttaatcatatatatataaactgatgtgaataaactaattcacactacaaggggatgcacctgcatcccctcatatatctattggcaaagaaaattagtacttctcaacgatagtagaacatcccattccaccaccgatacaaagtgttgcaagacctctgttagatcctctcttctgcatctcatgtaataatgtaacaaggatacgacagcctgaagctcctacaggatgtccgagtgcgatagcaccaccgtttacatttaccttgctcatatcgaatccaagatctcttgctacagcgattgactgtgcagcaaatgcctcgtttgcctcgataagatcgaaatcatcaattgtaagacctgtctttgcaagaaccttctttgtagaagctaccggtccaacacccatgatctcaggctcaactccgccaagtgctcctgctacccatgtagctaatggcttaacaccgagctccttagctttctcttcgctcattacaactactgctgcagcaccatcattgattcctgatgcgttaccggctgtaacaagtccgccctctttacctgagcagcaacgaagcttagaaagagtctctactgttgttccggcacgaggtccctcgtcctttttgaactcaacgatttctttcttaaccttaacaggtacaggaacgatctcatcatcgaactcgcctgctgcgatagctgcctcacacttctgctgtgagtttgctgagaactcatcaagctcttcacgagtgatgccgtatttatcacatacgttctcagctgtgatcatcatatgatagtggttgaatgcatctgtaagagcatcgttaaccattgtatcgatgattgttgcattgttcattctgtatccgaaacgtgcctttgtcatagcgtaaggagccattgacatgttctccataccaccggcaacaacgatatcagcctcaccggccttgatcattgtagcagcgtcgtttacgcacttaagacctgatccacaaacaacattgattgtgatagctggaacctcgattggaagtcctgccttgatagaagcctgacgagctacgttctgtccctgagctgcctggataacacaacccatcttaacctcgtcaaccatctcaggagcaacacctgcacggtttaaagcttccttaattacgattgcacctaaatctgcggctggagtattgcttaatgctccgcccattttgccgattgctgtacggcaagcacttgcgattacaactttctttgccattatattatctcctttaaattgtattgcacatccgtgctgttaattttttaacaaagttattatactacaaatttatgtaaaaatcaattggttttgttaataatttgtcaaatttctattaaactttgcatatttttcacgcgtattacttatactattccgtcagattaacaaaaaccgatgctattataacctgtggcatgcatacaggcataacacatcatatttttcattttataaaaaatccccgggcagcatatccgatatactgtccggggataaaatatattctatatactttttaaagattcttaactgttgcaatgtcaaccggtgtcttcttgtcagaagcagtctctaatgcatgtgcaagtgcattcgctgtatccatggctgtgatacaataaacacctgtctcgattgcatttcttctgataaggaagccgtctcttgtcttgtcgccgttaccctgtgtaggtgtatcgattacgaggtctatcttgtgtccgaggataagatccatgacgtttggtgactcctgtgatatcttgtttacgcgaagagcatttactccgtgctcctgtaagtactttgcagtacttcttgtggcataaatcttgtatccaagcttctcaaaacgctttgcaacgcctactgcctcaggcttatcggcatcctttacagtcataatcatctgcttgtacttaggaagctcgactcccgcaccctcaaatgccttgtaaagcgcaccattgaaggtcttgtcgattccaagacactctcctgttgatttcatctcaggtccgagtgaaatctcagcgccacgcagcttctcgaatgagaataccggcatcttgattgcaatgtaatcggctgtcggagcaagtccaggtgtgtagcccatgccctttattgtctcacccatgatgattcttgctgcgaggtctacgattggaatacctgtaaccttgctgatgtatggtactgttcttgaagaacgtgggtttacctcgataacatagatgttgtcatccatatcgataaactggatattaatcataccaacaacatggagtgcctgtgcaagtctctttgtatactcaaccagagtctcttttgctttttctgagatagtatgtgcagggtaaactgagatagagtctcctgagtgtactcctgtacgctcgatgtgctccatgatacccggaatcaggatatctgtaccgtcacagattgcatcaacctcaatttccttacccataaggtacttatctacaaggattggatgatcctgtgtgattgtgttgatgatgccgataaactcttcgatttcatcatcattccatgcaatcttcatgccctgtccgccaagcacgtatgaaggacggacaagtacagggtaaccgatctcgtttgctaccttctttgcctcctcagctgtaaatactgtaccacctgctgctcttgggatacctgtcttctgaagaatctcgtcgaaaagctctctgtcctcggctgcgtctacatcctcagcctttgttccaagtatcttgacacccatcttcataagagcctctgtaagcttgatggcggtctgtccaccgaactgtacaacagctccgtcaggcttttcaatattaacgatgctctcaacatcctctgctgtgagtggctcaaaatagagcttgtcagcaatatcaaagtcagttgaaacggtctcagggttgttgtttacgatgattgtctcccagccttccttggcaaacgcccatgtacagtgaactgaacagtaatcaaactcaacaccctgtccgatacggataggtcctgaaccaagtacaagcacctttttctgtggatttgtctctaccgcctcattctcgctgccgaatactgagtagtagtatggtgtctctgcttcaaactctgcggcacaggtatcaaccatcttgtaggctgccacaatgccgttgtcgtaacgcatcttcttgatatcagcctcatcaatatctgtaagctgtgagataacattgtcagggaactcgatacgctttgcctcttttaacaggtcaactgtaagctcctctgtctttaaacggttctccatctcaacaagtattgcgattttatcgataaaccaaagatctatcttagtaatctcgtgaatatgctcgtatttaactccacggcggagcgcctctgcgataacccagatacgtctgtcgtcaacaactgcaagctgtttctcaagctcatcatctgtaagaccagtaaagtcataagacataagtgaatcaacatgctgctcgagagatctgatagccttcataagggcaccctcgaagttgttgcagatactcattacctctccggtagccttcatctgagtggtaagtgtacgctttgctgtgaggaacttgtcgaacggaagtcttggaatcttgactacacagtaatcaagcattggctcaaagcttgcgtatgtcttctgtgtgatagcgttcttgatctcatctaggtgatagccgagtgcaatcttggctgtaaccttggcgataggatatcctgtagcctttgatgcgagtgctgatgaacgtgaaactcgtgggtttacctcgataacacagtactcgaatgagtcaggattgagggcatactgtacgttacagcctcctgtaatctgaagctcgttgatgatattgagcgctgatgtacgaagcatctgatactctttatctccaagtgtctgcgaaggtgctactacgattgaatctcctgtatgcacaccgaccgggtcaatattttccatgttacatactgtgatgcagttgccgttggcatcacgcattacctcgtactcgatttccttccatcctgcgatacatctctctacaagaacctctccgacacgtgacagacgaagtccatttgaaagtatgtctataagctcctgctcatcgtgagcaattccaccgccggagccgccgagtgtaaatgcaggacgaagaactacagggtaaccaatcttgttggtaaatgcaataccgtcctcgatattctttacaacctgtgaagccgcgattggttcaccgattttctccatggtatccttgaaggcctgacggtcctcagccttgaagatggtctctgctgttgttccgataagctttactccctgctcatcaaggaagccgcactcagcgagctccatgccgagattgagtcctgcctgtccaccgagtgtaggaaggatgctgtcaggcttttcttttatgataatctcttttaatgactcaagagtaagtggctcgatatatacctgatccgcaatctgcttatcagtcatgatagttgcagggtttgagtttaccagacatacctcaacgccctcctcttttaaggaacggcaggcctgtgttcctgcatagtcaaactctgcggcctgtccgattacgattggaccggaaccgataactaatacttttttaatatcattatttcttggcattactggttacctcccatcatgttaataaagcggtcaaaaagatatgctgaatcctgtggtccagggcatgcctccggatggaactgaactgtgaagatattcttgttcacatacttaagtccctcattagtgccgtcgttgacatttataaatgcaggctcagcaacattaggatcaagcttatctgtgtcaaccacatatccatggttctgggaagaaatataaacacggcctgttgcaagatccttaaccggatggtttccacctctgtgtccgtacttcatcttgtgtgtatctgcgcctgttgcaagtgccatgagctgatgtccgaggcagattgcaaaaatcggcacattgctgtcataaagcttctttatttcctttataatatctacacactcctttggatctccaggtccgtttgagagcatgattccgtcaggattgtcaccaagtatctcttcagcggttgtgtgtgcagggtaaattgtaacttcacagcctctttcattgagtgatttggcgatgttgtttttggcaccgaaatccatgagggcaaccctctttccttggccctttaaaacctttttctcagtgcatgtgaccttgtcaaccacattgcctgtagtatatgccttgagctttggaataatctcatcgagattgtaattctcatttgtggtaatcattccgttcatagtacccttttccctgagaatctttgtaagcgcacgtgtatcaatgccggccactcccggaatatcgtttttctcgaggaaatcctgtatcgtaccctcgcagcggaaattacttggcatacgcgacagctctcttactatatatccatccggccatggtctttccgactccatatccggtgtgattccataatttccgataagtggataagtcattacaacagcctgtcctgcataggaaggatctgtaagtacctccagatatcctgtcattgatgtgttaaatactatctcactaatgacttcccttgttgaaccaatgctggttccggtaaatacattaccatcttcaagaattaaaaatgctttcatctttaccctgccctttcgtgttatactttgtaaccataagcttcttagctgcaactaaccttacgtctgcgcaaaaaaaaagagggcgtctcttttttcttataaagtgtagttgcatagtatatctgcttaaattgtaaaaagtgtatcataatacagccgatttttcaactgttttttgttacataaatatgcatatttatgtatacaatattagttactgttcacaccaaagtatgaccggcaactattgcagcccattaaaactgcatctgagcgttacggagtaagccccgcgcataccgcatatatcagtcctgaaaaaaatacaaggcatgtaaagccaactgaaattgcaataaaagtcttatcagctatatgtcgcggtgtatactccacctgatatatgctttttgctgtcataggaacgtacatatcgccttgtccattgcaaaagcctccctgatatgcactcttaaagcccacacgactgaagtagtctgccgtgtatgccggcattgcatttacagacacctgcatgagcttaagctgcatgcgcgcatatatcctgactctctccagaagctttttgccaattccacgtcttaaatactgcggatgcacatacagcatggtgatatgcccctcgtttgtcatgccgcacactccgcacagcacattgctatcaaacgcaccaaatactacaagaacaccggccctttcctcgtccgtcagcctgtctgcatccatatattcatcaaaatatcgatgacagtcctgtgtccgaaagcagcctctgattgcgatattgtatatacttaccgcaaaggcacatgccccttttatctcttcatttgtaagttttcttattttcatcagatagtctcctccactattctgtctctaagcccgctatagcgtctctgctgtgagttgttttgtatcatctcataaaatgtctgttcgtcacccactatggtaacacatttctttgctcttgtaaccgccgtataaagcaaatttctgttcataagcattctcgggccgctcaaaagaggtataacgaccgccgggtactcacttccctgcgacttgtgtatagtaaccgcgtatgcaagttcaagctcctccaaaagcttaaacggatactccacctttctgccctcgtcaaaggatatggtcatggtctcggcaaaatcgttgatttcctcaatgatacctgtatctccattgaagattcccatgcccttatccacacaaagtccgaattttgtcctgatttcccactctatctgatagttgttctttatctgcatcaccttgtcgccctcgcggaaaatcgtgcccctgtattctttttcgcgcttgctcttgtctgccggattcatatacgcctgcaatataccgtttagacgttccactccgagaagtccctttctcataggcgtaagcacctgtatatcatactctgtagcatttacaaacttaggaagcttctgctttatcagctgtaatgtaacatttattatcttgtcggcatcatatctctttagaaaaaagaaatccatgctcttattatctaacgatacctcttctccattatttatcttgtgggcgtttactataatatcgctcgtgctcgcctgacgaaaaatctttgtaagctttaccgtgtggaaggcacctgaatcaataatatcctttagcacgctgcccggtcccacgctcggaagctggttcacatctcctacaagtatgagtctcgtacctgccacaaccgcttttagcaatgagtacatgagtgatatatcaaccatcgacatctcatctatgatgattacatccgtctcgagcggattcctttcatttctctcaaagccagctgcgcttcctgtgtccatgccgccgtttaactcaagcatacggtggattgtgcgcgcctcgtagcctgtcgtctcactcatgcgttttgccgcacggcctgtcggtgcagccagaaaaatatccatgccctccagctcaaaatacttgataatagtattgatagtggtagtttttcctgttccgggtcctccagtaatgactaaaaggccatttctgactgcttccttcaccgcctctacctgatgctcatcgagctccatctctgtctttttctctatatttctaattgcagcctctatctcgatatccggcacatcatacgtcacatcaagctgctttagcatggctgccgtgtttgcctccatataataaaaggtgttagcataaatctgggttatatcatcctttagctgcatgacaatcttcctgtccatggccagattcatgtaatgtgcctcaacctgcgagctttccactccgagcagatatacagcacgcctcgtaagctcctccatcggcagatatgtgtgtccatccatggcagcctgctgcaaaacatactgtataccgctttttattctaaaatcagaatcagtcttgatgccaacccgcgccgctatctcatctgcagttttaaaaccaactccgtcgatatcatccgccatgcggtatggattttccttgagcacgctgtatatctctccgccatacttattatatatcttcacagccagattcatattgatgccgtactgctgcaaaaaaatcatggcttcccttaagtctctttttgcattgacctggtccgcaatctccatagcctttctctggctgatgccctttacctcagcaagcctctccggctcttcctctatgatgcggaatgtatccttcttgaatcgcctgacaatacgtgctgcgagtgcaagtcctataccatgtatggctcctgagcccagatacctctcaatagccatctcatcctccggctccttctcttcaaagcttactaccttgaactgtctgccatatgtggcatgctctgtatactcaccgtgagcctctatattttcaccctcagcaatgtccgaaaaagtacccacacatgtgagttcctcctcgttcactacaagaacaagtaccgtatacccgttttctgcatttctgtatattatatgatcaacgtatcctgtgactgtttcggtttccaattgaatttctccgtatctgtgtgtttttattgtggttctaaaaaagccggtaaccacatgcaagcatgacggaccggctttaattcattatcaattattatgatatattgtagttgcgcttcatctgctcataaagctgctgtgtgatattctcaccggacttctccactatcgtatcactcatctgctctatgacattgtccatgaacatatccttgtactgcgacatagaggaatcctcatcatcactctttagtgtcatggaatccttcatttcctttatgacctgctccacgaaataagactcaaaatccttaagtgtgctcttgagctcgtcctctgtagagtctgatgacagatttttcacattatttttaagcttgtctgccactgcagacgtattatttgagtttgcaagtgttgatactgcgcttatatccatatgctactatctcctcaaattatttgctgtctcaagcatcgaatccgctgttgtgatggcctttgaattgagctcgtaggcacgctgtgccacaatgaggttaaccatctcgtctgctacctgcacatttgatccctcaagatatcctgtcacaaccttgctgcttttcagagcagggtttgcagcttcaagcatcggattgcccgaattggctgttgctgcaagcaggctccctgactgtttttcaagacctgacggattattgaactgatacacagcaattcgctgattcagattaatataattgccctgtgcagtcatataacctaccgcgccatcctctccaaagctcatcttctcagcagacacacctgccggcacagctatgatattaccgtttgtatccatgacaggattgccctgtgaatcagtaagtatagtctgtccgtttccatactggctccatgtgaaggcaccgtttctcgtgtaataggtctgattgtcagtacctctcactgcaaaaaagccatcgccctccaaagcaaaatcagtaggcctctccgtagaattgagcggcccctgagtataagtggatgtggttgcagccacacgggtaccaagccccacttgcgctcctaccggctttgcatcaccatttccggatgtagaacgggtctgtatcgtctgatataaaagagacttaaactctgtcctctgacccttaaagcctgtcgtattgacattggaaagattgtttgcaattgtatctacatttgtctgttcagcacgcatacctgttgcggctgtgtaaagcgccctcatcatatggcatatctccttatactcttcctacattgttgacagccttgtctaatgtctcatcaatagatgtaataaccttctgtccggcttcatatgcacgctgtatcgtaatcatattgaccatctcattgaccacattgacatttgaagtttctaaggctccctgttctatttcggcatcggaagctataatattacccccggccgtcagattgtagagattttcaccatatttttcaatatagtcataattatccacatcgacaacgcctattgtgccaactaactgattgttctgtgtgatatatccaagtgagtttaccgaaaacttctcattcgggtctacctttacccagtttgcctcaccgccatctccactcaatgcacctgtcgcattgagcacatggtctccgtctgctgtgaccagataaccgtcagcattgaccttgaaagcaccgtctctggtatactttacacttgtctgaccggatttgtcagtaaatgcaacggcaaaaaagccttttccaccgatagccaagtctgtaggattgtcagtcaccttaaagctaccctcatcccagtcggtatacgtctcaccgagatgcactccgtatgtcatgctgcccagatttttgtgcagtccgtagtttgatgtatcctttatctttatagcaagttcatttttaaatgaatgcgaggtggttccctcttttttaaatccataggtatcggaattggccaggttgttcgcaagaacatccatgcgcttcatctcattaaccataccggtgtgagcggtgtataagccttttaccatatttttgtcctttataatctgattctgttgataacgtttatctttgatgccttgtcggcaaaatccttttctgtcatatcgcctgttgtgaatgcatactcgccgtcaaccacatcctcaatgtagtctacatgtccgaatacagcctcaacctcgctctttggtgagtcagttctcacaaagaagctgtttacactgtcatcatagcttacaagtgtgagcttctcaggcttccagtcgatataaatattcgtgttctgatgctttgtcatatcaacaacatctgccactacagcacttgctgttggaagctttcctgctccactgccgtagaacatagcatctcccagcacatttccgcgtaaaaatacgccgttgaacactccatttactcctgagagcggatgtgtgtcatctatcatatatggtgcaacgagacaggtatagctgtcacccaccttgcggcttgaagcaagaagcttgattgcacggtgcattgcttttgcatacttaatatcctcaggtgtaatctttgtgataccctcacaatggatatcctcgaaatccacctgctgtcctgcaacaagcgatgtgagaatggctatctttctgcatggatcgtgtccctctatgtcggctgtaggatccttctctgcatagcccttatcctgagcatcctttaatacctcatcaaagtctgcaccttcctctgtcatctttgtaagcatgtagttggttgttccgtttaagatacctgtgatttcctcaatctcgtctgctgtgagacacttgttgagtggtctgataatagggattccgccaccaacactggcctcaaactggaagttcactccatgatccctggcaaccttgatgagctcagcgccctttgcggcaacaaggttcttgtttgatgttgctacctgttttcctgcctcaagcattgcctttacgaatgtaaatgcaggctcaacgcctcccattgtctctacaactataccgatctcagggtcctctgcaataaccttataatcatgaactattttgttctcgataggtgtacccgggaactctcttaaatcaagcacatacttgacctcgattggctctcctgctctctttgcgattttttccttgttgatttctaatacttctacgacacctgatccaattgtgccgtaacccataactgcaatcttcatctttttgttactccctggctaaaatttttacgtaatgtatgccctttaaggactcaatctgctttgccatatcatccacatcatccgactccggaaatacatccacagataacgtgagtgacgcaatgccatttaccggtacactttggtgtatggtaagaatatttgctttcgcatcggctaccgacttaagcacaacggaaagtatgccctgctcgtcatccatctgaatgacaagattcactgtctttcctttacgcccctcataaaaaggaaaaatatcatccttatatttgtaaaatgagcttctgcttatgccaacagcatctgttgcctcctgcacagattcaagcttgcccgaatccagcagtctctttgcctcaactactttaagcagcacctccggtacagcctttgcccgtaaaacgaagtagtttgatttctccgccatttagttacctccaaaatggccggtgtgtgtttgtcacacaccgacatttgtccttgactcaaagattttaacacaaagattacagctttgcaacatcttatgctcttggttttccacaattactgcagaatttacctgtatttttttgtccacactcacatgtccactctgtgtttacaggtaatggcttgccacagtttgtgcagaatttacctgtatttttctgtccacactcacatgtccactctgtaatctcctgtggcataggcttgccgcaattactgcagaatttacctgtgtttttctggccgcactcacatgtccagcctgacgcatcctcctgctgtgtggcacctgaagccactcctgctgccatacctgctgcaccatttcccggcgcattcattccggctgaccggttattttgtgccatctgtgtaaaaccattcatcatattacccatggtgctcattcccatgccgacacccatgaagccctgcatagctccaccactgttgctgcctgcattcttgacaccctctgacatatttttgaccatatatccctgtgcaatagatggatctgagagcattgcgccctcgtttcttgtgttaatgagctcctgagacttctcatcatatgaaaggctggcgataccaacactttgtacctccataccacgcatctgattccagctttcatcgagacacttcgccatatatcttccaagctcagatgccttgcttgtgacgaatgaaattctcgtaccatccgctgacatctggttgatggcagactgtaatgcctctaaaaactctgacagatactgctcattgatatcagtaatctccacatgatccatattctttggaatagcttctgcataaaactgaagcggattcacaattttgatggaatatgtaccatgggcacgaaggaaaagctccgcattataaaatgtatcatagtagtttataggatttctcgtaccaaacttgattcccttgatttcctgaaggttgatataataaaccttctgtgactgtggtgtctgtccaccaaatctcacacggtcaaaggtttcctttaaagaatccccaaactgtccgttgaaaagtgatggcatagatgaattgctcaccttgtagtagcccggctcagctgtgtaatccacaatcttgccaccatcaacaagtatcataaactgattgtcatatacatgaatgatagagccgtttgaaacaatatcgtcagagccttttttattctgccccctgtttaccagcacacccctggcatagactgtctggtcgcctatattatccggctcaataacctcctgccatgtatctgcaaagccgcctccaattgcctgttttactgccttaataattcccattttcttcctccttagatatggttgtaatcaacttcatgaaagctctgcagcttccatacttttatattgacaggctcaacatatgagccacaatattcacatttctttgctccaagacttctgaccggagcgccgcaattcggacatgtagtgccaactgcactgcctatccctgcattatccagcatatctatatcctgtatgtatacaagctccatattgtatctggtctgctttttatactctttatcaccactgataagctttcctgaggcactcttgtagtaaaaatactcaaccgcactctgtatactgatgacgcaccttccatctcttttcacatagtttgagatttcagtctgatgcaccctgatctcgtcaaaatgctctgtaaagccagctgcttcattgctgtctatacgcacctgcacctgctgtcttacctcatcagaagcctcacggtccagcttgtaaatatcctcagtcgtgattgcacaaagcgctgacacaagcactctttctgacattctcttaaactgttcccagacaaactccggaaaatccctttttatctgtggctccataaggcgcgtcatgcctgaaaccgacttgggagtcgtagagacattctccctgatacgattgatgccctctgtgacatcaggtgtaccaagaagactttcagacaaccgtctgactttaatgtaaacggtcactccggcagctgtcagaactgctaatatcaccacagctataactaaacccacatttgcctccttattctgaacgtgttgcaagccacttcagataaccattgataaatatatctatattgccatcgagcactgcatccgcattaccggtctcaacatctgtcctgtgatccttgaccatggtgtaaggctgaagcacatacgaacgtatctggcttccccagccaatttccttgacctcgcctctgatgcccgcctcctttgcagcattctcttcctgctttaaaagatacagctttgcctttaacatctgcatggctttgtccttgttcatatgctgtgaacgctcattctgacactgtaccacgatccctgatggaaaatgtgtgatacgaatagcagacgaagttttattgatatgctgtcctcctgctccacttgagcggtaggtatcaattctgatatcctcgtccttcacctcaatatcgagatcctcctcaatatcaggcatgacatcacatgatacgaatgaggtctgcctttttcccgccgcattaaacggcgaaatacgaacaagcctgtgtacacctttttcagactttagatacccatatgcattctctccgtttacctggaaagtaatggacttgataccggcttcatcgccatcaagcgaatcgagcacctcaagggtaaagccctttttatcagcccacttcgagtacatacgaaacagcatggacgcccagtcacacgactcggtaccacctgcacctgcattgagcctcagaatcgcattgcatttatcatattctcccgacaaaagagtcttcattctgataccgtcatatgtgctctcaaaatcatcaagcatctgctgtatctcgggtatgagtgactcatcgttctcctcatagcccatctcaatcatcgtctctatatcttcgtactgttccttgagctttgcgtatgtagctacatcatctttcatactcttaagctctttcatcttgctctgtgacttctccgggtcatcccagaagtcaggagcttccatttctcgctctaattcctggattttttcttctttattagccaggtcaaagtgaatccctcacttcctgtagtggggctttgtagccttggagcgtggacttgaaattatccaactctaccacagaatcacctctttctttgcattttagacgctttgtggctttaatgacgcttcccgcattcaagttgtggagtgcggatgtcacatagtatattcctctgaaaaatatgaagtcagccacgggatttttttcgaatagtgattttttattttcactttgtttcatttatatttttaatggaaccccgtggcagttcatatttttcttcggaacatgctgtgtgccggccgtaaacctgggtttacggggcgggaagctggttgtggcacatatttaaaagaatatgttatctgccatgttttttcggccagcgtcaatacctttattataccgattatattagaaaactgcaactaaatttggcacttataatcatgcttatcatcaagcttattatcatgtctgttgcgggtctcacctaacagtgttgtgactggcaacaattacagcccacttatcttcgtgtcttcatgttttcatattttcggtttcacagtgcctgctgtatgcttcttacgcgccacatgtgtaacaagcgcaataaatagaagcataatgataccgcctgcggtatcaatcgctacgtccgtgaatctgccggcccggccgggcacgaacagctggtgaaattcatctgtgcaggcatataggaaggtcacgcctatcggaatcaaaaatcttcttcttccatgcaagaacgaaaatgtcaaaaagccaagcaatgtgagaatggcatactcactcatgtgggcacattttctcaccggatagtctataagctctgccttatcgagcagctccttctcatcccagtggcttgcggtaatagtattgaccacagaaactatgcgatagctgacgctgccgctgagctcagacgactcggtgtcaggctccgccgaaaacataaagatgactaccatccaacacagcatgagaaagcatgcaatcttatttaagcttttcattcatcacctcaatcgctttctgaagctgcacatcatactgcatatcatagtctgcatttgtatctcctgtatattcataatcaacctctacatcaggctcgataccctttttatggatattgtgaccgtttggtgtgtagtacttcgatgtggtaatctttacagcatcgccatcggaaagattgtagatagtctgtacaattccctttccaaatgtctttttacctacaagtgtggcatcaatataaccatcctcattgtaatccttcatggctcctgcaaaaatttcagatgcacttgcgctgttttcatcgacaagcactacgataggacagtcaatctgttttccatcgtcatcaccaaatgtctggatatttccgtttttatcctttgtatacacgacagttcctgccggaagcttgccaactgtttctgcaggaagcagtctgtcaaccatttctgtcactgcggtaagtagtcctcccggattagcacgcaaatccactataaggcccttcataccctgatttgtaagtccgtcaagtgcatcctcaaactgacttgccgtgtttgtctgaaactcgctgacttggatatatcccactccattgtcaagcagcttgctgtccactgatggcagctcaacatttttacgctccacctcaacagtaaatgggtcagcctccccgccacgcctgatttcaagcgtaactttcgtgccctccttacctctgattttggcaacaagctttgtgagatcctcggatgttgcctcgacaccatcaacagagactatttcgtcatcctttttaagtcccgcttcctcagaaggtgtaccactgtataccttcgaaactgtcacctgctttgtattcggatcctgctttaacgcagccccgattccataatacgtgcctgtcgtactaatctgcagctccttatattcatccgcggtataataaaccgaataaggatcatttagcccctccatcacaccatgtagcagaccgttttccaaatcatccttatcgtaatcctcatagtagtactcgtctatgtagttcgcaagctcatcgattttctgcacggtcttgtcatcaagcacatctgcgctttttgcaacggtatgcacgctcctgcctgtaatcattgtgtatgcaaagagcacaatcaatccaagcacaatggtggtcactatacctgtagcaataccgacaccgaacccatttctaaatccctttctatgaggctttttatcgctcatatctgaattatcatcgtattctaagccgttgttgtttgaattatccatttcagtcctgtcctctctatattatgatatgaacttaaaacagcctgtctccgatcggagccaggccgtcataattattattatactcttaaatgtttccgaattgtgaaccggcttcccaaaaagccaattccaacgcccagtataagcgctaccggtacaagtgtagagaaaatctcctttgtcgggataaatgtcatcatatttcctataaaactaaacttattagcaatatatgcacaaatctttccatacatgacactgagcaatcccagaggaatcgctgatcctatcagtccaatcagaataccttctaccacaaacggagacctgaccagaaaatcagttgctccaataagcttcatgatagctatttcctctcgtctgaccgcaatacccgtagtaactgtgttgcttataaggaaaatcgcaacacacagaagaatcagaatgatacctcccgatacatagctgataagcttatttaaatcggtcagtgtattagccacatcctgcgactggtttacctttctgacgccctccagccccttgatatagttgacaagagtctgctgcatagagacatcattcaaataaacctgcagatttgctgaattactgagagggttatcatcaccaaatgaagctgcagcatcatcgtagccctcaaaatactccttctggtaatcactccatgcatcggccgccgactgataatccaccttgccaacctcagccctcttttctatctgagccttgtccgcttttattacatcctctgtagtgccctcattaaagaacactgtgacagcaacaccctcctcagctgtcttaaccatgcttgagaagttagtcacaactatataaaacagaccaaacataaaaatacaggctgccattgtcgctatggatgccagcgaaaacatcttgtttctgaatatattcttaaatccctgcttgattgaataaaaaaacgtattaatcctcatcactatcaccatccttgctgtcagatacaacaagacctttctttatagtgataacacgttttttcataaccttaacaatctcaagattatgagttacaacgataacagttgtgcctttctcgttgatttcctcaagcagtttcataatctcccacgcattgttattgtccagattacccgtcggctcgtcagcaagcagcatgctcggctcattgacaagagctcttgcaatagctactctctgctgctctcctcccgaaagctctctcggctttgacttgtactttgcagcaagccctaccatagaaagcatctgtggcacctttttcttaataaccgctgtggatgcaccgataaccttgagtgcaaaagctacattttcataaacatttctatcctttaataatctgaagtcctggaaaacgactccaacatttcttctgtatttaggaatctgcttgtggcgaatgcgcgtcagattccttccgtcaacagtaatcgttccgtctgtaggatcaagctcctttaaaagaagcttaatcaaagtggatttaccggatccgctatctccgcatacgaaaacaaactctccatcatcaatctcgagattgacatcattgagagcaggtatacctgcagaatatgccttactgacatgttcaagtttaatcattactttctccttaatagtccattgattccatatatttcatatatttgactaccataagggcaatcttaaatgtgatggcatcctcgaacactctaaggtcgagccctgtacttttctgaagcttgtccaatctatatacaagagtatttctgtgaatgtagagctgtcttgaagtctcagatacattcaggctattctcaaagaacttatttatagtagataatatttcttcatcaaaatcgtcaggggatttgccatcgaatatctctttgataaacatcttgcatagaggaatcgggagctgatatatcagacgacctattccaagctgggaatatgctataatattcctctcctcgaaaaagatttttccgacatcgagagccatcctggcctccttatatgagcgcgacacctctttcaactcattgataacagtaccatatgcaatatgtaccccatccgcttcggatctgaacagattcaaaatcacctcggctgtctttctgagatcatcataggtctcgttttctgccagttccttcactactattatattcttctcgtcaacagctgtaacaaaatcctttgatttgccgccgaaaagacttctgatcttctcaagctcgttgccgtccttctccctgtttgtctcaacaataaatactacccgtcgcacttcaatatcaatatgaagcttcttcgcgcgattgtatatatcaaccagaaggagattatccaaaagcagattctttataaaattatccttgtcaaatcgctccttgtacgcaaccagaagattctgaatctggaagcttgcaatcttgcctatcatgtagacatcctcgctgtcaccataagctaaaagcacatattccagctggtgatcatcaaagactttgaaaaactggcatccattaatcacctgactgtctgccggtgatgcaacaaaggcctgtgccggctctataaacgcctctgcattcggaaacgtagctgcaagaatcttgccctcaacatctatcacacaaagatcggttctcgtaattcctttaaggccatcaattgtattttgaagtatctgattggaaatcataaatcgttctccttctcccctttttgtaactgtgcattgccctcacagtcactttataactaattgcataaatacttgctattattttaatacattcgcacaaaaaaataaagaggtaaatgtacaatttttacacatttcctcttattttttcttttattgttataagaattaactatattgaactgttttgtctatgttcataggtgttgataagatgcgtaaggcgcttcacatcaagcatttttcttatttttccaataaatccatgctttttccccatgaacttattatttccgattccgtaccagaggttcatcaacagcttttccctgttgtgtaaaaggaacttctcctgtgccggagacggaagaaatgatgcaatcacatcaggtgaaacgatgttaatttcattgacaagattttcgctgcatcccggtgagtcatcaagaacacccttgccggatattcgcgctctgtcaaataatccaagcagaaattcctcagcctcatcaacagctttctgcgactctgcaatcacaaagatttttttatcattcctctcaagcctcttaaaaagctcataaaagaagtcatgatcttctatctcatgccgacgctgcaaagtatctgccgataccgcccttagtatgccttcatccgcaatgacagaataatcgcacgcctccagcgcctgcttcacctcttcatcagactccgccaatgccagcgtatccatattcacttcctctattgtagtgagtatcttctctgaaatacgcctgtcgactctcataagcatctcacgtactgtatagttatcaagttgtagccctgcaatatctatctttttaatcataatttgaagtataacaaaattaacttacataatcaacacttttcaagttgtccgacaattataaagcattttaatcatattatttacaattaaaatgtcaatattatttccgaaatattactaatttagtgcaactttatcagaactttacaaaacagttgttcttttgctctcatttaaaaatgtggataatgtgcataactccgtgcataactcattttaagggcactttgaggtttacttttgttgatagttatccacatttatccccaatccgaatttaccgggtttagcatatccacttttttgtgcatgttgctattttgatatatgtaataaaaattacgcttgacagccctgttttccattctgtttaaattagtcccgtttttaaacatatatgtatatcatacaggccacttatttcaaatatcataaacaaaaataaagtttctctatgtaaaaaagacctccatctcgatgagatgaaggtctttatagattcatatttacctatccggcatgaatttattagaaaattcttctaactgcaatgattgatttgtagttagccggtgatgtatatttgataccgtctgatgggttgcttgcatgtacaatagtgtttccaccacagtagatagcaacatgtccgctatagcagatgatatctccaggctgcatatcgcttgtgctcacaccgtatccaacgcttctcattgctgatgagctgtgtggtaagctgatgccaaactgtgcataaactgacattacaaatcctgaacaatctgttccgtttgtaagacttgagccaccgtaaacataaggattgccaacgaactgtgatgcataattaacaacagcctgtccgtttgaaccacttggtgcgctatagctcttctctgatgaagaactgcttgttgatttgcttgaagacttagatgacttctttgctgctgccttggctgcttttgcttcctcagcctttctagctgcttcctcagccgccttacgctctgcctcttccttggcaagtcttgctgcttcctcttccttagactcagcataagtgaactctgtatcgagtgtcacataatctgtagatacatatccggtaccgtctgctgtagatacacctacccatccagctgttgactcatccacaactgtgagatcatcctctccggacacgagaccaagtacttctgcatcagtagatgctgttgttctgaccttgagtgtctcagtattgactgttgccacgcgacgtcctgcgctctgtacgagtgcatcgtcaccaactacaacataatcgccttttacatatcctgttactgaaccggactggattttgtaccatccgttatcggttgtctcaagtactgttccaattccattgttatagagttttccaagagactcgctgttttcatctgcactcgcacgtatattaacgctgtcgctaacctgtgcaactgctgtatcagcatatgctgatttaaccggctcagcatctgttgccgcaacatctgttgcagtctctgatgtctcatcaccttttaacattacatctgtcaacatagatgtaacaccggctgtaagagtgtttgatgtactaacaatatctgatgtataactagctactcctgcagtaggtccagccgcatatactgcatatggcactgaggacagagccataaaacctgtaagtaccccggctgtgagtttcacataatttactttcattttaccctccgttgtatgaatttgtaacagttattacgaatttgttacaaatattactttgtcattatagcaaagcaacatatatatgtcaacgttttcttagagaattcttaagaaaatcttgactttttccaacgaataggacttatgtcgcatgaaatacttatgtaataattttattttacagcaatagcctcaacctcaagcattacatcctttggaagccttgcaacctcaacacagcttcttgcagggtatgctccgttaaaaaatgtggcatatacctcatttattgcaccaaagtcattcatctccttgatgaaaactgtagtctttaccacattatccatgcttgttcctgctgcctcaagcagatgtgacagatttgtaaatgcctgctttgcctgtgcctgtgagccctcaggaatctcaccggtctccggaactaccggtatcactccggaagtatataccataccatttacctcgatagcctgtgaatatggtccgattgctgccggtgccttgtctgtactgataacgtttttcatgttattgtccttctttcctgttaaaatttattaaaaagactgttatttcttaagacggattttgccatctgtgagatcaatctttctttccttatataaatgaccaactgcacgcttgaatgcatttttgctaagtcctgtttctctcttgattacctccgggcttgccttttccgaaaacggaagcacccctgcgtatgaatcaagcagttcaaggagcttttcagcgtcggaatccatctgaatatatgccttttccctcattgtcaggtctagcttgccatccgccttgacatcagtgacctttgcctctatcacatctccaagcttcagataagcggcattctcaaaaaccggtatcttggctgaatatttgtcatccacagcgataaatgtaccgaaattgtcgctaaaatcatacactcggcctgaaaccatatcgtcctttttgtatggcgaatcggtgctcagcatatggtaaataccctttgtggtagcgcaaagcctctggcttttatctatgtataatgtaacaagtatctcatctccggcgctgacctttctgaccatctccttgtaaggaagaaacaggtccttttcaagcccccagtcaaggaacgcccctattttagtcacctccttgacagtaagcactgctaaacctccaagtgtcagctttggctcgtttgtcgtagcaataagtctgtcgttagagtccttgtatacaaagaccttaagcttatccccctgctttactccatccggaatctgctttgccggaagcagtaccctctcctccgaagccgaagatgttgacagatatatgccaaaatcaaccttctttacacatacaagctcctgatattctcctaatctcatgtttttccgtcctttctgtatcaaaactgtatcgttattaaataatggaattataattatttttccggtaccggcttactcaaaaactccaccaccgaatacggttttttatccgtatccgcaagcaccactgtcacactctttgatgtgtacttcacgtatgatataactgtatcaccaagctttgcttcttttctgtactccacacgaagctcagatatttcaaaatcattcggcagaagctgctgcgccagcataacatacttctcattgttcatatgatggttgctgtctataaaaaactgaggaaccacaatctcaccctttttctccatatcatcaggaatatgaagcttgcgctttgcacactccatctcaagctgcggctcaagaccgtatgtatccgcaaactcctgaggcaccttcaccggtctgccggttcgtgtatcaacaagtacccagacagaattggcatatgccagtgtgctgccgcctgcatcttcaagtgtgaaatttctgtaaccgtaaaacgccttcataccatatgcccatgtggatatctttacctgttcattaagcagtggaagcctgtttatgcatatctgccatgatgaaagcacccatgctatatgattgtccgcaagaaatctgattcccacatcatgtgactgcgagtgaaacacactacagtcctgaaaataattggtaagccccgtaaggctcagtctgcatgacgaatccacctcgctgtaacgtattctgctgtcaaatgaaaaagccatatctaattcctctagtctataaaattgaagtaacttctgataaatctaaacgcttcatccacaccattggacatccaaagatttgagcttttattaatgatatcctggtattgctgtatagtaattggtgtctttttttcagagccgagttcttctataagattaataattctcaaaaaattcttgttcatatcacaccatccttctataactgtttaagtcatatacgtttttattttataacaaatcgcattattacacaagaaaaaaagggaacttctatcgaagttccctttagctggcccacaaggattcgaaccttgaaatgacggagtcagagtccgttgccttaccatttggcgatgggccaatgtgttgtctcaacaaaagatattatacacatgtggctatatagtgtcaagcatttttttattttaattgaatgtaattgaatataaattctgcttgtcctgctaaaatgtgagcatcggctaatttttaaacagcaacacctcgccatcatattcagcaaatgtcacctcatcgccccactcaagctttgccgtgccgtttgtctgctctatgattgttttctctatgcgttttttatcattttccgggataacggctttcacgagcacatccgcctcatacgctgtgtccatcaccgtaatcttctcctgtgcaaacagatactgaagtcttccgattccggtatagtctgtcctgataaacagtactgcaccatccttcttctctattatctcacttgccgaaagccccgcctttgtggcttgctgatacgcacgcaccagtccgcctgtgccaagcagcacccaaccgaagtatctcgttacaacaacagcggcattatggatattttccttaaggagcacatcaagcataggacggcctgcggtgcctgcaggctccccgtcatccgagcatctggtcagctcctgtctctttcctataacaaaggcgctgcagttgtgccttgcatcccagtatttctttttcgtctcattgatgaagcttacagcctcatcctcagactctaccggccttacggttgctataaacctcgatttcttctctgttatctcaccctgtccgcccttgtacacgtacaggcttatagtattctctgacatattatattctttccatcctgatattgcctgattacagtcatgccttttaaagacacctttatcgcgctgtaattattacctgtattatataatatgaaatccaatctgtaaattgcatttaaatgctatatttgatataataatgtatactgtttattttctaataacagtatatacaaacaagattacaaatctttataatgacaaggaggcctatatatgaattacggcaaaaaagctacaatgcagctgctccggaaatatgacaataagagctctaaggtcaaaaacaagttcaagctcattgttctaaagattcttctggttgtagtaattgtagcaggcgcagccggcatcagttcaggaatcggtgtcatgaagggaatcattgattccgcacctgacatatcaaagatcgatgtcactcctaccggctactcaactaccgttctggcggcaaacggagaagaaaccgccacactcgtaggtcagggggcaaacaggcagtatgtcaccatcgatgagattccgctggatttgcagcatgcttttgttgcaatcgaggatgaacgcttttacgaccacaacggcatagacctgcatggtatcggaagagcctttatctccggtctgtcaaagggcagattcagtgagggagccagcacgataacacagcagctcatcaagaacaacgtactgaccagctggacaagcgaaacttcctttgtagaaaagcttcagagaaagattcaggagcagtaccttgcccttgagctcgaaaagcaggtaaacgacaaggactggattcttgaaaactacatgaattcggtcaatctgggagcaaataccctcggtgtgcaggccgcatccaagaagtactttaacaaggatgtctcagagctcacgctttctgaagcatctgtcatcgcaggtatcactcagaatccatccggctacaaccctatcacacaccctgacaaaaatgccaagagacgtgaaaaggtgttaaataacatgaaggatcagggctatatctccaaggcgcaatatgatgaggccatggccgatgatgtctactcaagaattgctgagtacaacaccacaggctcaggctctgtgaacacatactttattgatgcactcatcgacaacgtgttcgacgatctcacagccgccggttactctgagacagaagcctacaagctgatttacaagggcggactgactatcaaatcgacccaggaccttactatgcagactatatgcgacgaggaggcaaacaatccatccaactatccgtccgacgcaaagtattcgttccagctttccttcgaagtaaaaaaggcagacggttcgtacaagacctacacgaaccagaccatgctctctttttataagaagaaaaccaacaatgatgatttcagcatcaactactcaagccctgatgaatgcaatgcagctattgcacagtacgagcaggatgtacttgaggagggcgattcaattgtggagggttctgaagctgtcaatatcacgctggaaccacaggttgccatgacagtcatcgaccagagcaccggtgaagtaaaggcactggtcggcggtcgcggtgacaaatccggcaacagaacatggaacagagctacagatacatgcagacagcccggctctaccttcaagataatcggctgctatgctgctgctctcgatgcaggcggcaaaacacttgcatccgtgcaggatgatgcaccgtttacagtaggttcaaaaacctttaacaactatgacaaatctttcggaggctttacctccatccgatgggcaataacaaagtccatcaatattgtaacagtcaaaaccttacaggatatcggggttgatctcggttacaaatatgcggaggatttcggtatttcaactctcaccgattccgacaaaaacctgtcactggcgctcggcggactgacaaagggtgtcacaaaccttgagctcacaggtgcatatgctactatagccaacggcggagtatacttagagccaaagttctacactcaggttcttgaccacgatggcaatgtattacttgacaagaccactacacaggacacacgtactgtaatcaaggatactacggcatggcttcttacagatgccatgaaggatgttctgacacagggaaccggaaagctggcgcgctttgacagccagatagcccaggcgggtaaatccggtaccacaaccagcaaccgcgactgcctgtgggcaggctacacaccatactacacatgtgtcgtatggggcggctatgatgacaactcaaaacagtccggcaagctcacatcctaccctaagaatatatggaggaatgccatgagcagaatccatgaaggactagaaaccaaagactttgtacagccggatggtataacaaataccacggtatgcagcaaatcagggcttgttcctttagagggaacatgtgacaatgatcctcgaggatcaatgctgacaactgaatattttgatacggacactgtgccgacagacagctgcgaccatcatgttgcacttgagatttgtgccgattcgggagccattgccggtccatattgtccgaataaaacatcaaaggtatttataacaggcgctgtatcaggcagccctgaatatgaattcatggcagatgatacgttcatgaataccgtatgtacattacatgatgcaacatcgctgattaacagctcaccaaccaccacggatcctaccaattccggtactacaccgggcagtactgatggcactgcggctggagcacagacaggtggggctgaaactggtaccggtgctggctcaggtgctggtactggtagctccggtactggcactggcggttccggttcaagcggctctggagccggtgcttccggtaccggtggctcaggttcaggtggtactgataccggcagctccggttcatccggtaacactcatcgttaaccattacgattcacaacttaattatctaaagcaaaacccccaaggatcatatcctcgggggtttttgttgatgtatatatgctaaggggattagataataatttgcattactctacatcctgtaatgcctcaattccttcctcgcctgtacgaaccttgacaacctgtgccacgtcgtaaacgaagatcttaccatctccgatatgtccggtgtagagagtcttcttagcagtctcaataaccttttctaccggaatcttgccaacgattacctcaaccttaacctttggaagtaatgtcgcatcaagctcagctccacggtatttctcgccggcacccttctggataccacagcccataacctgtgtcactgtcattcctgttacacctaagtcattcatagccttacgaagcttgtcgtactttgtaagctttgaaataataacaaccttgtggataccgcttgctgaagccggtgttgttgcatttacaacaggcactgctgcatccttctttgcctgagaagctgttgcatactcagaagaaccaaggtctgtattttcattgacatccataacatcacctgatacatccatgatagcaaatcctgcgtatgctgatggaagaccatgctctgttgggtcaagtccgatgatttcctcttcctctgaaactctaagtcccagtgtagccttgataacaaggaatacgattgtaatagtaactactgtccatgctgcaacagaagcaaatcctgtgagctggagtcctaaaagcttaaatccaccgccgtagaaaagtcctacgagctcgttaccctttgaatcagcaattgaatatcccggagcactgtttgtggcaaaaagaccaacagcgattgttccccagataccattcatcatatgtactgcgacagcacctacagggtcatcaacacgaagtacattgtcaaggaaccatacaccgaagcagacgagaagtcctgctacggaaccgataatgatagcaccaagtgcatctgttacatcacagcctgctgtgatagctacaagtcctgcaagtgaagcattcaggcacattgacacatcaggcttgccatatttgagccatgtgaaaatcatacaaactactgttgcaagtgcaggtgcgattgttgttgttacaaagatagaaccaagctgctctactgattttgctgctgcaccgttgaatccataccagccaagccagagaatgaatacaccgagcgcaccgattgtgatgttatgacccggaatagcgtttacttttgtaatctttccgtttttatcctttgtaaactttccgatacgaggtccaagaattgcagctcctacaagagcactgataccaccaaccatgtggatggcacatgaacctgcgaaatcatggaagccaatctgtgaaagccagccaccgccccagatccagtgagcctcgattgggtaaataagtgctgaaataactcctgaataaacacagtaggaaataaattttgttctctcagccatagctcctgatacgatagttgctgttgtcgcacagaaaaccaggttgaatacaaagtttgaccagtcaaaatctttgtaagatgtaaagatgtcaaatcccggcttaccgatgaaaccaagaacatcttcacctaataaaagtgaaaaaccaatcagtatgaatacaactgtaccaatacagaaatccatgaggtttttcataaggatgttaccggtattctttgctctggtaaaacctgcttctaccatagcaaaacctgcctgcatccagaaaaccaatgctgctccaataaggaaccagactccgaaaattactccactaatctcttctgtcatagtaatgtcctctctttcctgtttcttctttcattttttcattttatcgaaaataaaatttataaaaaaacagagacacttcaccaatttccacagcttcgtggttcagcaaaatgtctccattttattattatgttaaattaaatcatatatgccgctctaaacagctttccgtaagctttgggccttaaactacaaggattaaacctcgaagattaaatcgccgtatgatggcattggccacatctctttgtcgacaatcatctcaagctcatcaaccggagtacgaagagcatccatagcagtctttacaacatctctgtagtaaacagcctgctctctgccctcttccatagcaccggcctttgctgtctcatccttaagctttgcaagtgcaacctgtgcatctgagagaagagctgagctctctgtaagaagctctgactgaacagatacatctgcatcagcaactgcactcttaactgagttaactgactgtgcaagtgatgtaatatacttgataactgcaggaataatctgctttccggcaatatcaatcatagcctttgcttctatattaatagtctttgcatatgtctcatactcgatctcggcacggctctcaagctctgtctttgtaaatacaccgaacttctcgaatgctgcaactgactcaggagcaacgtatgcaggaattgcatctaccatagacttgatgtttggaagtccacgtctctctgcctcagctacccactcatctgagtatccgtttccgttgaatacgattctctggtgctctactgcgtaatccttgatgagatcatgtacagcgaggtcaaagttgtctgccttctcaagtatatcacaagcgtctgagaatgcctcagcaacgattgtgttaagcacgatgttggcctgtgcaacagaatcctgtgaaccaaccatacggaactcgaacttgtttcctgtgaatgcgaatggtgatgtacggttacggtctgtagcatccttcatgaaatcaggaattgtcttaacacctgtctcaagcttctcaccctttaagctgtgtgtagctgtacctgttgcgataagctggttcaatacgtctccgagctggtctccaagataaatagaaaggattgcaggtggtgcctcgttggctccaagtctgtgatcgtttcctacatctgctgctgccgcacgaagaagtgctgcatgctcgtcgattgcctttaacatacatgtgagtacaagtaagaactgtacattgtcatgtggtgtcttgccaggctcaagcatgttgataccatcatctgttgtgattgaccagttgtcatgctttcctgaaccgttaactcctgcgaatggcttctcatgaagtaagcactggagtccgtgacggcctgccaccttcttgagtgtctccatgataagctggttgtggtcaacagctacgttgcactcagcatagataggtgcaagctcgtgctgtgcaggtgctacctcgttgtgctgtgtcttggctgaaacaccaagcttccagagctccttgtttacatctctcatgtaagctgcgattctctcacggatagctccgaaataatgatcatccatctcctgtccctttggaggcatagctccgaaaagtgtacgtcctgtgaagataagatcctttctctgtaaatacttctcacggtctacgatgaagtattcctgctcaggtccgacagaaggtgtaaccttctttgatgttgtatttccgaataatctaagaagtctcagtgcctgatcattgattgcttccattgatctaagaagaggtgtcttctgatcaagagcctcgcctgtgtatgaacagaaggctgttggaatgcaaagtgttgcgcctgctgcatcctgtctgacaaatgcaggtgatgtacaatcccaggctgtatatcctcttgcctcaaatgtagcacgaagaccacctgatgggaaagatgaagcatccggctcaccctttattaactcttttcctgaaaagctcataagtacttttccgtttggcattggagaagtgataaatgaatcatgcttctcagcagtaacgcctgtaagtggctggaaccaatgtgtatagtgtgttgcacccttctcaatggcccattccttcatctcgtgtgcgataacatcagcagtctcgagatcaagctcctttccttcgtccataacctcatggagcttcttgtaaaccttctttggaagacgctcctgcataactgcatcattaaatacgttctctccaaagatgtctgctacgttgaaatattcctgttcgctcatatcttacatcctttctgttcatcaatccccttgagtgaattgttattttcaaataatgtttaaacagctgcacaacatataaactcgaatattcttgttttatgccggacttcttagtttattaaaaaagagggcactccatctatggtggaacgccctcgttcatttcgcttaacattatttctgaaattaagatactcctttgagtatcaaaaatcaagtgtttatgttaaaaaagttaagttttataaaattttactacaagatataaatattttgtaaagtagtatgtgcaaaaatactaaattgcaataatattattcagcctttccaactgatccgaaaagctccatcttctccttaactgttgccttgattgcctcagcaccaggagcaagaagcttacgagggtcaaatcccttgccctcaagatcttttccggcctcgatgtatttacgtgttgcatctgcgaatgaaagctggcactctgtgttaacattgatcttagatactccaaggtcgattgctttcttgatcatgtcagctgggattcctgtaccaccgtgaagtactaatggcataacaccagtcttctgctggatagcgtcaagagtctcaaagctgagtcccttccagtttgcaggatattttccgtgaatgtttccgattcctgctgcaagcatatctacaccaagatcagcaactctcttgcactcatctggatctgcgcactcgcccattccaacaactccgtcttcctcgccaccgattgaaccaacttcagcctcgatagacatgcccattgcatgagcaactgatactaactcttttgtctttgcaacgttctcatcgattggataatgagatccgtcgaacatgattgatgtgaagccggccttgatgcacttgtagcatccttcgtatgtgccgtgatcaaggtgaagtgctacaggtactgtgataccgagctcgtcatgcatagccttaaccattgctgctactgtaccgaagcctgtcatgtactttccggcaccctcagatacaccaaggattacagggctcttaagctcctctgctgttaaaagtactgattttgtccactcaaggttgttgatgttgaactgacctactgcgtaatgtccttcttttgctttcttaagcatttctgttgcagatactaacatattttttcctcctgttaattaaaagctaatgttattatattacataaccttataaaaataaagttaaatttttaacacaatcagacaaaaaattgtgtactattactattttatgtccgattttgtatttatcagcacataatggtaatctgtttgttcagattagtgatggtcagatcggtgtggctgccgccaaactctccgtcgagtgtccacggtacctcctcctcactctccacatgcagctcactggtcttgaaggagtagatgagctcattgtcattttcacggtttgccagtcccgcaagtatcttgttgagctcgattgggttttttggattcttgatgagtgtcacctcaaaaagaccgtcatcaagcagtacgtcaggacctgatatgcccttgaagcctcctaccgaaagggagttggtcaccattccatatataaactcatcctctattatctcaccgtcatggctcaccttcatcctgtacgaggtgatatccatcaggtgctttgcaccctctaaaatatatgcggcatgtcccagtatatttttcatctgctgcgaggtctggtaggatacctctgtaaaaaggccaaaggctgcgacatatacgaaggtatctccgttgaagcctcccacatcacacgggaatggagtaccgtttacggcaactcttgcggcctcctccatatttttgggtatgccgagagagtttgcaaagtcattggtgctgcccgcagggatgtatcctatcggtacatttacctcgctttgctccatgccggtcaccacctcgtcgagtgtgccgtctccgccgctgcacactacaaggtcatacttcttagcatttttcatgaccttttttatggcatctccctgacactgtgtaggataaatggtgattttgtatccggcctttgtcatgatgtccacgatatttaccaggtgctcctttatgagtcccttgcctgatttgggattaaatacaaataaaagctttttcttcatctatctcagttcctccgcaatcgccgataattttctaagcctgtggttgactcccgatttacccattggcggatccagatatcctccgagctcctttagcggtgcatccggatattcaagccgaagcagcgccatctcccgaagctgcgccggtaaatcatcgagtcctctcattttctgtatcagtctgatatcctctatctgctttactgccgcattcacagtcttgctgatgtttgcggtttcgcagtttactttacggtttacactgttgcgcatttcctttaatatgcgcacattttccagcttcatgagtgacacatacgcctccatgatgttgagactgtccacgatgtgggcgccctcctttatgtacactacatagtgccccttgcgctctactatcttggcatccgtatcaaagccgcacaagagctcctgaagctgccttgcctgctctttcgtatgacacactatctcaaaatggtacgctttgttggggtcgcttatcgagcctgctgccatgaaagctcccctgataaaggctctcttgcagcatgtctgcataagaagcagtccgtctgcggtctgtctgttgacaggctgtgccgtgattttaagcgctgcaagtatctttccagtatcctgctcatccagcgcctttgtggtatctgtgccaaaggcacgcttcataagtgtggcatatttatttaaaagcagcaggttttcggtgtcgagctcaagtccctttgttttttcattgatacggcccgaaagctctatgatgcctgcaagctcagcgagctgacagtgcctgctctttgatacctgctttgccagctcttcctttacatcactggaaaacgacatgttatttacctctcaatgcatcctttcctatgtcgcgatgctctatcttaagtccatagtcattacagccgctaagcctcttgtacagctcgtttgcaagcgttaccgagcggtgcttgcctccggtgcagcctatagatataacaagctggttcttgccctcagagatatagtttggaatgagaaactttatcatatcatcaagcttgtcgataaactcatttgcctccggaaactgcatgacatagtcctgtatctccttatcattgccggttttcgcgcgcagtccgtccacatagtagggatttggcaaaaacctcacatccataactatatcagagtctgacggtatgccatacttgaagccgaaggacagtatcgtgataaacagattcttgtaatcctcattctgcacaaatatcttttccagctcaattttaagctcccttgtgagaagctggcttgtgtctatgatatagtcagcattgtcctttaaatactgcagcttttccctctcaagcacgatgcccttattgatgcgctcacttcctgcgagagggtgattacgcctcgtctccttgtatcgctttacaagcacctcatcctcagcatcgaggaaaagtatctcatacggaaaatttttctgccttagctgctcgagtgtctgtggaatcgcatcaattcctgagccgtttcgcacatctatgccgactgccaccttggacacatcactgtgaaaggtgtttgaaaagtctatgagcttatctaatagctgtataggcagattgtctatacagaaatatcccatatcctccatcattttcattgctgtgctttttccggcacctgacatgcccgtcactattacaaatttcactagaattctccaatcatcttaacttccggttcgagctttactccaaactgctttaaaactgtttcctgcacgtcttttatgagtgtcaggacatccgctgcagtggcttcgcccttattgactacaaagccacagtgcttctccgacacctgtgcatctcccacgctgtaacctcgaaggcctgcatccatgataagcttccctgcaaaatagccctccggtctcttaaaggtactgcctgcacttgggtactcaagcggctgcttctccactctctttgcgcgaagctctgccatatatgactttatctcatccttaggctttggtgtgagtctgaatctggctgacagcactatatagcccttttccgggactatgctgtgcctgtaggataagtcaagctcatcccttgtgacagtctttagctcgccctctgctgtgagcactgtggcatcgattaggacatcctttatctctccgccgtaggctcctgcgttcatgactaccgcgcctccaacacttcccgggatgcccgatgcaaactcaagacctgaaagcgatacctccgctgcctttgccgccactgctgcaaggatagccccggcgcccgctgtgatgatatgaccgttgtcttgtgctgtgaggtcctgcgctgtgctttgctgcgccacagcttctgtcacctcgatttcggacaggccttttccaataccaattacaaggcctctgatgcccttatctcctaccagcagattgcttccgtttcctatcactgtaaccggcatatcacatgccttagccatctctataagctttgaaatccggctcatatcaggctctgcatagtaatctgccgggcctcctatgcggaaggtcgtgtgttttttcatcggctcatcctgcagaagaccaagctgcggcaattgttctgttacactttttacaaatgtctgattcatcttatattcctttagcctatgcttccttcaaaaatgcaatgtagcctctgaatgcctcatataaatcgaccttgctgatgatttcccatggcgcatgcatgttgagcaccggcacaccgctgtcaataacattcatgtcatagtttgcgaggatatatgcgattgttccgccgcctccctcgtctacctttccaagctccgctgtctggaatgaaacatctgctgtatccatgatatttctaagccttgcaacatactctgcgttggcatcgtttgagcctgatttgcctctggcgcctgtatatttgttgaacacaagaccctttccgaagtatgccgagttcttcttttccataaccgatggatagttcgggtcaaaggctgctgatacgtctgatgagagtacctttgagtttttcagtgcacgtctgactgcaagctcgctatagtctcctgccaggttcatcacctctgccacacagttttcgaaaaagcgtgactgcatgccgctggctcccactgagccgatttcctctttgtccacaagcaggcatacacttgtatattccggtgtgccctctatctcaagcatagctctgtatgaaggatatgcgcacactctgtcgtcgtggccgtaacccatgatcatacttctgtcaagtccgtagtctcttgcctctccggcaggtaccacctctatctctgctgaaaggaaatcatcctcgtccacaccgtactcctgtgaaagtattgtgaggatattggcctttactctctccttaatatccttgtcgtcatcgtccttttctggtcccggtatgcttccaatgagcacatcaaggctctcgccctttatgacctctgaagccttcttgcccatctgctcgcctgacagatgaataagcagatcgctcacacccactacaggatcatttggcttgtctccgatattgactgtcactgtgctgccatcctttttgcagatgactccgtgaagtgcaagcggcagtgtaacccactgatatttcttgatgccgccatagtaatgtgtatcgaaaagtgccatgtctgtgtcctcgtataaaggcacctgctttaagtccattctaggtgaatcaatatgggctccaaggatattcatacccttctcaagagacttactgcccacgataaacagtgccagtccctttcccatattgtttgctattatcttatctcctgcctttacgctctttcctgtctcgatgagctcatcaaggtccacaaagccgtgtcctgtggcgtcagcataaactgctgccgtgcactcgcgctctgtcttgcagccggatataaaccttctgtaatcctctgcaaatgcaaataatttttctctttcaggtccctggggatatttctcccaggcgtttttcttttctattgccatgatttattatacctccgaattttttgtaagattttcctggacgcggcgatacagctcctgagctgcattgtagcccatcttcttttgtctgtgattgactgctgctgtctctacgatgaccgccagattacgtcccggtctgattggcagtgaatgacacactaccttgttgccgagatactcggcatattcttcctcgaggccgagtctgtcgtaatctgcctcctttttccagtcctcgagcttgattacgagatctatctgctgtttttcctttacacactctactccgtaaagtgtcttgacatcgatgattccgatgcctcgaagctctataaagtgtctggttatctcaggcgatgtgcccatgagcgtatgctcgttgatctttctgatttccaccacatcatccgtcacaagacgatgacctcgtctgatgagctcgagtgcggcctcactctttcctataccgctctcacctgtgatcataactccctcaccgtatacatctaccagcacgccgtgcactgtgatgcatggtgcgagctgctcaccaagacaatagatgagctcagccataaagcttgatgtggaacggcctgttgacagcaccggaataccgtgctctctggcctcttccataaatatctcatccggctgtaaatctctgcagaagatgatacatggtatatcaaactccatgaagcggctatagcgctcttttttctcgctgtcgctcatcttctctatataagtatactctacatttccgataatctgtattcgtctctcctcaaaatgctcaaaatatcctgagagctgaagcgccggtctgtttacgtccgagcactctatcgtcctctcctttagattcatctcttttgtgagattgttgagatcgagcaattctgctacctttgcaactgatactgagtgtaatgcattcattcgcggtcccccttgatgtatatttgttttttagtatatcacagattagcttcaaaatctacgtggcagagtggaaaaatgcatatactgcctgtgctgctttctcgttcatggtctctgtctgcataaggtcttcgacatctgcttcctttatcttctctagcgactggtagcggcgcatgagcgcctttctgcgtgccggccctatgccttcaatatcatcaagcaccgaatgtacctgactctttgagcgtagtgacctatgaaactctattgcaaagcggtgtgcctcatcctgtattctcgtgatgagcttgaagccttcgccgtggcggtcgataggtatctccacattgttgtaataaagacctcttgtgcggtggaaatcatccttcaccatgccacacacaggtatgtcgagtccaagctcggaaagcacctgaagacatatatttacctgacctcttccaccatccatcattataatatccggaaaacggttgaagctgcctatttcctgtggagagccatctttttcaagctgcttctgttcttccatgccatgtgtaaagcggcgtgtgagcacctcgtgcattgacgcataatcatcaggtcctgtaactgtgcgaagcttaaactttctgtaatcgctctttttaggcttgcccttctcatacactatcatggagccgacggtctcaaagccgttgatatttgaaatatcataggcctccatacggtttaagccgtgtaagcccaaaagtccctcgatttcctttacagctcctattgtgcgcccctcttctctctttatccgttccttatcctggctgagcactaagagtgcgttcttgtaggcaagctcaacaagcttttccttcatgcccttctgcggcacttttatattcacccgcctgcctcgcttttcgctgagccactgctccaaaacagccatatcctctatctcgctctgcagcatgacctcgcgcggtataaaaggtgttccggaataaaactgcttcacaaagttatttagcacatcatccgctgcctcctcgcttccgaccctcacatggaaatggtctctgcctatcagctttccgtttcttatgaaaaatacctgcaccactgcatcagtatcgtcatttgcaagtgctatgatatccttatcctcgccgtcggcatttgttatcttctgcttctgtgctacctgtttcacactatttatcagatccctgtattcagccgccttctcaaactccatgctctctgaggcctttagcattttatcgctaagagcctttaatgtctgctcgtagtcgccgtttaagaaatctatagcgccctttacagatatggcatactcttccttcgtcacatacccctgacatggtgcattgcactggtgtatatgatagttgaggcacggccggtctgctcctatatcacgcggcagcctgcggttgcaggtgcgaagcttatagattttgtttatcagatctattgagcttttcaccgcagaggcactcgtatacggaccaaagtaacgggatttgtcctttttcatctgacgcgaaaacagcaccctcggatagtcctctcccagtgtcaccttgatgtacggatatgtcttgtcatcacgaagcatagtattgtactttggtgtatgctcctttatcagattgcactccaaaacaagggcctcaagttcagagtcggtaactatatactcaaaatgatctatatgctctaccatctgttttttcttgatgccctcattgtggctcgcctgaaagtactgatgtactcgcttcgtcaggcttttggctttgccgatatatatgattacatcatccttgtcatgcataatataaactcccggggcatccgggagtttttttaattcttctttgatatcaaatgttttttccatattcgctcttttaggttgtgaggttgccggcatggcacacagtgtattcctcaggaaaatatgaagtcagccgcggggtttctctccgtttggttttctttgtttgtaaggctttttcgtcccttttcttgcccggaagcccgcggcagttcatattttccttctgaacacactgtgtaccctccggcttttttcagtttatgtgtgcgaaactcttttctactgcgcttttttttacgctctttcgctgcgcgaaaattgccctataaggtactaattatttgatgtatcatccggcgctgtatattcagaagattcatttgtatctgcaggttggtctgtggcgttacggaggagcggatctgctgctgatgtctcatcattctgtgcggcctcctgctctttgttctcctcgtccggatctgggagtcccttcatatcgcggaacatcttcatgaattccttacctgtgattgtttccttctcgtagagataatctgatatactgtcgaggatttctctgttttcatcgaggagcttcatggcctctgcgtagctgctgttgatgattgagagtacctcatcatctatctgcgatgctgtattctctccgcagattaatcctgctccgccctctaagtactggttttgtactgttgcaaggcacatcatgccaaatttatctgacattccgtacatagttaccatggcacgggctatctttgtggcattttctatatcatttgcggctccgcttgtgactgagttaaataccagcacctctgctgcacgacctgccatatatgttgtgattttggcgagaagttcatcctttgtctcaaggtatttctcctcttcaggtgtctggagtgtatatccgagtgctcccatggtacgtggtacgattgtgattttctgtacaggctctgtatttttctgcagggctgatacaagtgcgtgtccaacctcatggtatgagacgatttttctctctttatcactcatgacacggtccttcttttccttgccgccgactgctacaagctcgaaggcctcaaagagatctgactggtttacaagctgtctgccgtttttgactgcattgatggcagcctcattaatcatgtttgcaagatctgagccaacaagtcctgctgttgcaagtgccagtgcatcgaagtctaccgactcatccatcttgacatcctttgagtgtacctttaaggtctccagacgtccctttaagtcaggcttgtcaacaatgattcttctgtcaaaacgtcccggacgaagaagcgccttatcgagcacctcagggcggttagttgctgctaatataagtaatccctttgatgtatcaaagccatccatctctgcaaggagctggtttagtgtctgctcacgctcgtcattgccaccgccgtatctgctgtcacggctctttcctattgcatctatctcatcgataaagataatagatggtgccatcttttgcgcttccttgaacaaatcacgcactctcgaagctccgactccgacaaacatctccacaaagtctgaacctgcaagtgagaaaaacggtactcctgcctctcctgctactgccttggcaaggagtgtcttacctgttcccggaggtcccacgagaagcgcacccttaggcagctttgctccgatatctgtatatctcttaggattgtgaaggaaatcaacaacctcctggagagattccttggcttcatcctgtcccgcaacatccttgaaggtgacacctgtggacttctccacatataccttggcagtcgatttgccgactcccattcccatgctgccgcccatcttctttgaaacaaatgctaaaagcacccacagcagaataagcggaactataaagcttaatatattaaaaatccatgtagatgtattatcaggtatcgctgcctttatctcaatagacttgccctctgaggtctttgcttttttgagtgtcggcacaagctcatcatcagccacacggcctgtgtaatatgtgatgtcataattcttgtgtccgtcatccacaagcttgtagtctatctcgtaggaatcaaactccacgctcttgacattacccttgtcgagctgttttatgaaatcactgtatgacttttcctgtgtgctggcatgcgatatgctgtttgatataagtgcatacacaaacaatgccacgagtgtcagcaggataaatgccatgatcccttgtccgccacggttgtttctgccaccgtttccaccagatctgttaccgccgttatttccgtttccaccggacccattattgcccggaccattgttgtaattatagttattaggtccctgattatccatattttctccgttcttttcttatttattacaagcttcaaggcaattttgacctgtaatttttatagtcattcccatgaaaccctatccccgaaaaatatcattacagacttcttattttccgaggaacatattgtatatgaaactgtctcctcacaatatataaagtgtgaagcttcactttattataagaaaaagtgcggtcaaaatcaaccgcactttctaaatattgtattaaatataacgaaaaattatctgttcaccttgtttgccgcctctatgaagccatggaaaagcggatgtggacggttcggacgtgacttaagctcaggatgtgcctgtgtggcgataaaccacggatgctccggaatctcaatcatctccacgattctgccatcaggtgatgtaccacaaagcttcatgccatgctctgtgagagctgttctgtagtcattgttgacctcataacgatgacgatgacgctcgcttatattctctgtaccgtatacctggtatgcctttgatgtcttgtcgagtacacatggataagagccaagtctaagtgtacctccgatatcctctatcccgttctggtcaggcataagtgcgataaccggatgagtagtgtttggatcaagctctatactgtgtgcgtcatggaacatacatacgtggcgcgcatactcgatgattgccacctgcattccaaggcagagtcccagatatgggatattgttttccctggcatacttagctgcagcaatcatgccctcaacaccacggtctccaaagcctcccggaacgataattccctgaatacccttgaatacctctgctgcattgtcatcattaagctcctctgagtcaacccactttatatcaactgtggtatgctcaggaataccgccatgcttcaatgcctcaacaactgaaatgtatgcatcgtgaagtgctgtatattttccgacaagtgcaatcttgacctctttatcaggatgacggagatcctcaaccatctgcttccagtctgctagatccggctcaggacagtcgagattcaagcactcgcatgcaacctttgcaagattctcctgctccatggcaagtggtgcctcatagagatactccacatcaaggttctgtaatacatgtgaattcggtacattacaaaacagcgcaatcttgtccttaagattctggtcaagctcatgctctgaacggcatacaatgatatccggctggattcccatgccctgaagctcctttacgctggcctgtgtaggctttgtcttgagctctcctgacgccttgatgtatggaatcagtgtcacatgacacaggatggcattgtcgtgtcccacctcatgctggaactgtctgattgcctcgaggaacggctgactctcgatatcgccgactgtaccgcccacctcgatgattgcgattgtggtatcctcagatgtgaaatccctgtagaatctgctctttatctcattggtgatatgagggataacctgtactgttcctccgccgtagtcaccacgacgttctttctgtaatactgaccagtatacctttcctgtggtgacgtttgagttctttgtcaggctctcatcaataaaacgctcatagtgtcccaggtcaagatctgtctcagctccatcgtctgttacaaacacctctccgtgctgaatagggttcatggtacccggatcaatattaatgtatggatcgaacttctgcattgtcaccttgtatccacgagcttttaaaagacgtccaagagacgctgcggtaattccttttccaagaccggaaacaactccaccggtgacgaacacgtattttacaggcataattttcctccttatcaatatgctttgtatatttgtaaattcttaatttttaaaataaccaacttattatacagccttaaattgattaatgcaatttatttttttattatatttattatattttgttataatgcttcacatctggtgacggacaaccctgtattcatcgcctgagcggtaaaacggacagcgcttatagctgctttggacaaatctcgccatatcatcctcgtccatatttaccgagcaataatactcctcatcatcctcatcatattcattgtatgcacaaaaatcgcagcatgtctccattatcttatccttccatcacttttaatatgtatgctgaaaatctacttaaactgattgacagtctcgtcatatttgtaatcaatctgtgcaagcttgtcgcaaagctctttctcatcaatatcatatgctgccgcaagctccttcaatcctgaataattgtcccgaagctgtgtgtttacaaagctaagcagcataaccggatcctttggtaatgccataatctgctccttataattctatgtaattttataattctatgttatcttattatcataatcatagcaattaattttcaaatacctgctttatgctgtcatagtgcaggaacacaccctgcgcagcaagctcttttatttcatcgagtgtggcaattttaaacccaagtgcctcctctgtctgaatctgtacgtcagactccttgaaatcaagctcaaagcggtaaacatccacgaaatagttgtcaccctcgcccggattttctctgtgataggtataggcaagccctcccgaacactgtgatacatcaaggcctacctcctccttcacctctctgcagactgcggtaaatgagctctcacctgcctgtgcagctcctcctgaaacctcccaccagcccggtgcccatgcctttgtcatgacacgctgtgtgataaggaatctgccatctggtctgtgaatcacgccaagcactgaaagatgatactctccatccttaagtatccagtcgttttttttcattgtacggcctgtcggctttttatccttatcgtatatatcccaaaattccatttgaagcttcctttctctaagcgggtctttaatgatatcatatcatatcctgcgcagaaaagccagcaagttgtttacgcagctttttgctttccggcagataatattccatcagcgaccagaacctggcattatgacttggttcaagcagatgtgtaagctcgtgaaccaccacatactctgcgcactccgacggcaccttagccagcagaaggttgaaattcagatgatgtgacttaacgttgcatgatccccaccttgtcttcatcttctttatcgtaaagccggctgacttaactcccataacaggctcccatttgtcgataagcctctgcagctgcatcttaagctgcagacgcatctccctttccatgaagggtgccataaccggctcctgttccttaagctgtcttgcgacaagcatttcctgcatggtttgctcaatccagtctgatttgctctccacaaatttcctgatttctgtatcactcatgccataaggagcactcactgatagtgtgccatccgtgtccttcacacgaagatacatgttttttattcttttcctagtcacttctattgcatatctgttgtttatatatatgttatttgtacattttttatttgcatatgcgttattcatattttccagtttcatactgctcctatcacgtaatccgtttcgcataattacattttacaatctctgtgcatttttgtatactataaaataaagttactgaatagttacaaaacaaatataaggaggctcctatgacaaaagaaaaattagccattgaagtaataaaaagactaaaaaccgcatatccccgcaccgattgcactcttgagtacgacgaggcctggaagctcctcgtatcagtcaggctcgcagcccagtgcactgatgcccgcgtaaatgtagtcgtggtggatttgttcaaaaaatatccttccatcgaggctctcgccgatgctgatgtttccgacatagaagaaattgtacgtccatgcggcctgggaaagagtaaggcacgtgatataagtgcctgcatgagaatgcttcgcgatgattttggcagtcttgtgcctgacaatatgaccgatctgctgaagttgccgggagtcggaagaaagagtgccaacctgattatgggtgatgtgtacggcaagcctgccatcgtcaccgacacacactgcatacgcctttgcaaccgtataggacttgtagatggaataaaggacccgaaaaaagtggagatggagctttggaaaatcatcccacacgaggagagcaatgacttctgccacaggctggttgatcatggacgcgccatatgcactgcccgaaccacaccgcactgtgacatgtgtgtgctgaacgatatatgtggaagcgttgtgcatagctaaaacagtaaggctgcgtctccgcagcctgcatgcaaaacgtgagaaaggaccgcgatgttacacgcggtaacaacgcgatcctttctcgaggagtttagttatgaaaatgtttattaataaaaagggaataatgtaaaaggttttgttcctcttacattaacaatgtatatgtggtaattatgtcctaacaatgtacattttagaaatattttattaaaaaagtcgtgattattttatactttttttagatttgtaatattctgtaaataacaactaaatttttttgttaaaaagtgccttacagagctgtattttatcctcatggctctgtccggtcaggctgttttgaaaatccacagtacctgcagcggtgctgtctgtcagcagacctttttctgcgagacgtcttttcatctcacgcgctgtaccgtttcctccatcgaacacacgcaccctatctccaagcacctcctgtatcatttttctgacaaacggataatgtgtgcatcccagcacaaccgcatctatctcatcatgcgaatatgaatacaaaagttcctcgagatactgtctcacatcatcaccgtacaagtcacctctctcaacgaaattcataagtccaggacaaggcaatggaataatctcacccaagtgtctgtatctgtccataagctttttaagtttttcctccctgatagtcataggtgtagccatcacaagcactctcggattttccataaaaagcatcgcaggcttgactgcaggttctatccctacgataggaacatcgggatattgctctcttaatatacgcactgccgcgctggtggctgtattgcacgcgacaacaagtcccttagcatgctgatttaaaatcagctcctttgcatgctcacaggtcaaagctcgcacctgctcaagtgttttggtaccataaggcgcatttgctgaatcaccgtaatatataaaatcttcgttaggcatcacttcaaccaggctctttaagacgcttattccgccgactcctgaatcgaaaactgcaattgacattataaaagtccctactttctttataaaatctgttatgatataatgaataaaacaagcttaaggaggcacctatggataatcctaaaagtctttttaacaacaacacaaaagtatgtgaaaactgtaaaaggcctctgccacatgactataaagagaatctctgcccacgatgccttgatctggcattattccgcgaggtaaaggaatttatccgtacccacgacgtaaatgaatacgaggttgcagaacattttaagataccgcttagacaggtaaagagctggataaaggacggacgcatcgagtacaagcagtctgaatcaacctccactatagccggtcttcactgccagcggtgcggtgcacctgttaccttcggcactctttgtcccaaatgtctgagactgttaaacggcaacaaaggatactcaaccggatacgatgccggcaaaacaaaatccaaaatgtaccatttggaaggagaggagtaattactcctctcttcttttaacctttgacctgtattttttctcaacctctgtgaggaacttgtcatcaagctccgcctttataagtacgttctcatcaggcgatttgatgacgatatcataataaggtacatccttctgacctgaggtatagtctattttcttgatctcatttccattctcgtaattgtatacacttctgtcacctgccggtgcaattgctgctacagactccatgctgtatattccaaggcgctttctgcggctcttgtttttaattttggcaaatcgcagctctccgtcaaaatatgaatattcaaactcggtgttctgtgccattatcataagatatgcaataagtccaaatactactgcaaataaaatacccggtgcaaatccgatgcagatagtcagaagacttatcgcagcaagagctacaagcaggtacgaaacaaataccagcgccacattttttttacgcgcaatcaatgtaaatacttccattataattctcctttgcatattgaaaatatatatctttataatgataacagatttttaccgtttcgtatagattttttcatgtttataggttaaaatattataaaaatttagtgaaatttcggagggttaagatgcaatttaacttaaaactgcaaaatgatttcaaaaacaacataagaagggagtgggctttaaccaacggccttggcggatatgccggcggttcagtcaccggtgcgataaaccgtacgcatcagggctatctgattgcaagccttcatgcacctgtgcaaagatacgtctgcttttcaaagacaaacgaaaaaatagtcacagacagccacacctacgacctctcaagtgaccagttcaagggcggatgccacacagacggcatccaatatataagagatttcacatacgacggaaccatatgctttacatatgaggccggtgatatcaccataaaaaaacacatcgcactggcacagggaaaaaatctcgctgccgtggcatatgaggttcaaaacaaaggcgaagcggctaagcttttgatcacgcctcttatgaacttccgtgagcactctgaaagttccaccgtcgattcattaaaattcgaggtccaaaagcaggagcatggctttagtctcatcccaaaagctcaggatgaccactgtatccgcattgctttttcaggcggagagcttattgaaagagacgacaaatatatctgtgaccttgaggctcagaccgaggtggacaatgaagtgcccggcctcgactgtgcattttgcccatatgacgtgagtgtggatattcctgccggtgaatcaatgcatttttctgtaatgtgcgatatcgggccgcttgaagcctgtaatgacaactcaggcacagccttcgccaaacaccttgtttctgataacgaaagtgcttttaaaatactacgtgcgcagcttgactacaccgatgagctgattaaaagaagcggcttcactgatgactttgccgtgaagcttactgtggctgcaaaccagttcatcgcacacagacagtcaacaggctatgacactgtgctcgccggacttccttggtttacagactggggccgtgacactatgatttcatacactggcctgacactttgcaccggccgttttgaaaaagctcacgatatactactgacctttgccaagtattgtaaggacgggctcatcccgaatatgttcccggacagcggacttgagcctctctacaatactgtagatgcatcactgtggtatttttatgctgtctacaaatatcttgaatatgtgtctactcccgatgcctatgaatttataaagaaggatatttatccatgcttaaaggatatcatatctacttataaaaaaggcactgatttttccatatatatggacacggacgggctcattcatgccggaagcggactcgaccaggtaacatggatggatgttcgtgtcggtgactgggttgctacgcctcgtcacggcaagcctgtcgagataaatgcactttggtacaacgcactgtgcaccatggatatgcttcaggctaagtttggcgataacgatgacagctacagacagcttgcttctctcgtaaaggcttccttcaacaagcgcttctggaatgaaaacacaggctgcctgtatgatgtggttgacgaggatgacgatacaatccgtccaaaccagatttatgccgtaagcctgccatttaccatgcctgacatggagcgtgaaaaagcaattgtggatacggtaatggataagctgtacgtaggctgcggactgcgttcgctcgatcctgaccacaaggattaccatccgatttacatcggctctctctcaaagcgcgaccatgcctatcatcagggaacagcctggggctttctgctcggtggttttatcagtgcctatgtaaaggtaaacggccgtacgaaggcgaccgctttatgcgctgacaagctgcttgaccctgtaagggagcatctgctcaacaactgtatcggctcaatatgcgagatatttgacggcgatgcccctcacaccggccgtggctgctatgcgcaggcatggagtgtaggtgaagtgcttcgctgctactgtgaggatgtactgcctatgctcccacaagctcactcataagctcgtggaccgtagtcatccggtttatgcggcccacattggcaccgcagaataccagaccgttttgcatatctcctttaaccgctgcaatcagtgccttcgtaatacagtacggcactgttgcagggttacatttctcaagacaattgtagcactttgtgataggctgctttttcttttccaaacccctgataaactcatttctgacagcacgccccggcattccgaccgggctttgtataatctgcacatcagactcattcgcgttcagataagcatgcttataggcatcagatgcgtcacactcctctgtcgccacaaaacggctcgccacctgcactccgtcggctccaagctccatgcagtgcatgacatcctcatgtgtaaacactccgcctgctacaattaccggaatgtgctttttaaacttctcctcatatgcctttgcacagctgataatctccttaatctcgctgtcataatccatatgctccatatctgcaagctgttcattggaaaatcccagatgtcctccggcctttggtccctcgataacaataaagtccgctgtgcggttgtatctgtgtgcccacattttaagaatcagatttgctgctctctttgaagaaacaatcggagcaatccttgtatgtgacttttcatcgaccagctcaggcagttccattggaagtcctgccccgcttataataacatcagcacctgcttcaaccgcagccagaacatgctccttgtaatgctttaaagccaccatgatattgactcctaccattccatgtccacaggcaagctcctttgctttcttaatatgcttcttgatagcaatcagattagcctttgcctggtccttttcaaactccggctcctcaaagccaatctgcgcggtggaaatcactcctacaccaccctccttagcaacagctccggccagtctgctaagactcactccaactcccatacctccctgaatgataggaagctttgcaaccatatctccgattctcagttctctcaacataatatgtacctccgaacatgtataaatttcatttttatgtttgatattcaaattatttgataatcaaacatatatacatagtagccctttaaggtattcatgtcaagataaaattatatcattttctattttatatagtttttaatactacattccttatttattgtaactatccaaattttctcaattttaatattgacatcaaaagacaaatcgtgtagaataatttttgttgtgaggcaagcccagttagctcagttggtagagcaacggactgaaaatccgtgtgtctctggttcgattccggaactgggcattatacaacaaattaaatattcctatgcgggtgtagttcaatggtagaacaccagccttccaagctggatacgtgggttcgattcccatcacccgcttttttgttacccttttttgtttgtccactaagtatttcataatgcatttaaactgtcatacagctgcttttacacatacttatacacaaaacaaaagccgatacaccgtgtctccacgaaatgtatcggcttttattatgcgctagataaaatatgtattccctaataatgtctgactagaataaatctacacgacctgaaaacttatcatttataacatagtatgcagaatactcctccggcttgatgtagatgttaagctttctgatgaagcctgccttgtgtccctcagcaacgaactgagccttaacacgctcctcgacagctgctgtatcaacctcgctgttctggtactgaacaataatctccggctttaccggctccttctttgcaggttttgcctctttagctgtctttgcagcttttgctgcctttgctgttgtcttcttaacagtgtcctttacatcagccttaacctcagcggccttctcagttgtcttttcaacagccttctcaaccttctcggttgtcttctctacggctttttctacctcagcctttacatcggcttttgcatcagccttaggctctgaaaccggctgtgccactgtttcctcttttttaacttcaaccggccttactgcctgcttaactgtctttgagttattctttttacgcatactattttcctcctcatgctcattattcacatactaaaaaattttcaattgcaactaaagcttcctgctcatcatcaccctttgtaacaatatcaacagacattccatctgaaggattaaatgccataatacccatgatgctttttgcattgattttgcgattgtcactctccaatgtaatctcactatcgaacttgcatgccacttgaacaagctctgcgattggattatcatgaccttcacatacttttgtaacgacaatactcttcttactcatacgttctccttaaacaaaaagtattaaacctgtttcatacttatttaatatatcccaattgtaaccgcttttcaatccttatgaaaatttctgttaaactttacctaaggagcttatatttaatgtcacaaaatcggcattattacaacattattctgtttattttgtcatgtacgtgataaaatgcaagccaccattataaaacattctgtcagcatcctcatggctcatcgatgttgttgcgccattatccggattataaatatataaagctccatttgaagagtatcctgtcacaagcactgccgacgtatttcccgtcatcgcaaataccggattgccctggctgatataaaagataatatcctcagaagacactccctgtaaatccaggatttccttgtccggcaggttatttttgagcacatcaacagcactgctgcctgctccaatcagctcagacacacttaccgtaacatcattgtaggttagcattgcacttactgacttcacgacactgtcagcatccttatcgatttcattacatgcaatattcgcaaatgcatttactgcattttttcttgccctcatccatacatactgctggtttgagtcaattaccactcccatactgtcatttgcctgttttatggcatccgagatgttatcagatgcaaaaatcacatccccctttgcataaacatagaaatggactgtattgtcatcaaactttaaatcaacagcagtatcatgcgaatttatagtcatctgtgctgtcagctgcttcagcttatccggctttttaccacctgctatactaatagcgctgaccgtcagctttgtatcggactgactcatatcaagagctatcttctgcttcgaatcagcctcccggttcataatggtatcctgaccgatttctgcatacacaccattgttttgtgcaatcagatctatcgttaccgtatatccatccacagaaattttctcgacatagccgcccgaaggggtatatgtcttaagctccgactggtcagatgtatcaagaataataaggccattcatcggaaatgtcgtgtttccggctgcatcagagaccacatcagcagcattcgcctgtccatatatgaaatcctcacctatgaagccaagcggacgtagatactggtcgtcgccctttttgacctcaaaggtcttgccactctttaaatccattacttttatggtatttgatgagtactgatttgcagaatccacccatgcaaagtatctgttactctccgatgcgcagtaagagcctgtagacaagccctcaaccaccttctttactgacatcgaacctaaattaatcctatatagactgtcatccatcatgagatagaattcattcttctcattaagataaagcatcttgcccatctcagcctttagcacctcatatgatgtcttagaaggaataaacgcttcctcatctatagtatgtgccagaccgtcataatggtacacaccggttcccacctctccctcgtgggtgcctctgttcatatatccgtataccacaaaatcaatactgcccgcttcgtctacactgacaatctttatatcgtgatgattccagttctcacgctcatcaatgccctcagcgtccctgaagctgaataccttgattatcattccattgttgatatcataggagtataaatctccctcctggacaaagcatatcacactacctgcttcattggccctgtactctgcctcactgcttctgataccaagcattacgctgcctgaatccgaaataaagctgttttcactgttaaaaatctgatttgccgttctctcatagttgagcacgtacatacggctttccgtctggcgcagcctgaaatattctcttacattgtaatactcagtctcacccttaccgtccacacagctcatcacatagtctattgtaaccacatcataagaatcgtttatttcctttagggctatgacaggattcgtatactgtgcagcggccattgagccccaggtaatctgactcaccgtagatgtcagatccacatgtgcaagcgtatttctgtcaccggttgttgtctccatatatgttgtaaagaagaatttgtcatcctttataaacgtctcatcatgaaacttctttgcaaactcaacaacctttgcagcggcctttccatcggtctgcataatcctgctgtaataatatacattatcctgaccgcttgtgatggtaaacaccaaaagatactcagtattttcatccataacattcggcatgcttatgtccgcctgaatagtattatccttattagaaaaagaagatatctcgtcatcggccaccagcctcttgccatccatgcttctgatcttgtatgatattctgtcaacagccataccatatgttgaaatggataatgagagcttcctgtcatccgaaattggaataacgcaatcgcgcatctttgtcggatccatctcagtagtatatccatggagggggtttatctttattttatccagattaaatgacataaccggcagcgttgcatccgcctgcttcgtggtcatatccttatttcccttgtttgtagttatgcaaaatgtaattaatgctgcaataaatactactataagtactatcggctttatcactttcttactcataaaatcatatccttatatctaccagaatctttggtaccttctgtatctgcatcttcgtctgcagagttcacagttaaaaagtatgcccgctattgtacagataaagcacctgctgctttgctctgagataaatctgccggcaatcctgtctgcctcatcgaaaagacgctgcctgtcaggcacctcatcatagataaagctgccctcatactccagctcatccatgcgctgctctactgcggactgtatcatcgccgtatcaagcggatacatatcctttatcatccccaggtcctttgcaaatgcctcctcatttttatagtaatccataaacggaaatgttttataaaaaggtaacatcaaaaaacctctttttaatcattatatgctatattcagctattagttgcatgctataacaaacaatgctgcaataaaaatgcatgcgcccaggaatttctttcccgataccttctccttcagtatcacggtggagcatatcatcatcacaataatcgtcaaattaaaaatataccctgcatagctgccggacattgaaactgccctgccataaaaatcatatgctaacgggtatgcaatgcctgcaagaatcaggcatataccatcaacaaatgacatggatctgattttcttcatgcctcctgttgcaatagtaaatataataagcaccagcgttcctataaacacacaccagaacgcaataaagcccttatccagctgtatctcgccaagtgacaccagaatatgtgctgccgatgcacaaactgcagcaagaagcgcaaacaaaatacctgttccatccagatttaaaataaccgttccaacaatcatgagtgcaatcgctatataatcaaaagtgtcaggggtgttatgaaacagaaaaaatcccgctgcaagcgtgattatatagctgcatttaactatagctgtaacctgaaatgtgtagccctcatgtatggatttaaaaaaacagatgccaaaaagccctgttgcaagccctgccagaagtataaatataacgctcctttggccgagtgcagtcaggctgcttcccattatattatctttcctgtaaaaaaatatagacgcacataaaacaatcccggcaatgcttcccgccagcgccgggtctgtctttttagttccaaccttggccaaaataggcacacatgctgcaataaaggttgcagcacatgcccatataattcctgtcatatacattacctcaccatgtatctattactgtgactgtgcagcactatctgcagctcctgttgtactgccatctgctgtaccctgactggcagccccgctatctgccgcacctgatgtgccgctgtctgtagtgctgtcagccatatctgacttgacgtagtcagagctgacatagcctgtctgtccctggaagataacctgtgtccagccattgtcctctgatacaaactcaagcttcacatcctgtcctataacagtaattatatttgcgtttttatcaggcttctctctcatgtttacactgcttgtagtggtgacataagttttttcggtcccctctgtagtctgctgtggcagatatatggcgcctatctctgtaccactatcgccggcactgtcagtttcactttcgctaactgcattctgttgtaccttgtcctgttccttttttttgccgccctttgaggtaatggtaatcactattgtagcaatcagggcaataagaaaaagacatattgctgcaaaaatcagtctggcgattataacatcttttctgtggctcgctttcatattattctccttttgtattatctgtgttttggctcattatagcataataatctaaaaagaaaaaggcagttaatagaatgtttattggtaaatttctataaattaccttataatatttttaaactacagcacatcatatcagagggagataaaatcatggaacaaaagacaccttttaaggagctgacattcagtcagaaaatacaatatatatgggactattacaaaataccgatatttcttatcattatcggaatcatagcagtcacaacctttatttgcggccggcttgcgcagaaaaatactgttttgagcgtattatgcgtaaatgcagaaaacagcaccacagaggacaacggcgccgatattttcaatgactttctcacagataacggctatgatttgtcaaaggatgaaattgccttaaacaaaaatatctgtgtcgatgtagacaaaagcggcctagactatcagaacatggcagtcctcacagcatactttgcttctaacgaatacgatatatgctttatggatgataagacctttgattattacgccaaaaatgtctgctttgaagatataagcaaatatctggataaagccgtccttgaaaaatataaggacaggcttgcatatgtgacaatagatggtaaggaatatccttgtggtatcaggctttcagcagatgacaatgaatttgtcaaagcctccggcttatactcttcatgtactgtcggagtgtgctgtgactcctcccacgatgctatggtcaaaaaattatgcggctacatattacagtagccgcatttctatttcttctgcttttatcttatgaatttctcctgtttttaagcttcaagattccacctattgcaagaagtactacactcaggcatgaaacaataaacaaatcaggaacataatcctttattacccagtatggtatgcctccgacaataggcgcaataactatgcccaccggcaaaaacagatgcaggaaaatatttgctatcaggtttccgctattgtctgttctccatttgtgcgacttgataatctccatcagcgcaaccaatataaatgctgcaaaaacaaggtcatagaacaggtgcgcatcgacataatcctttgggtcaagctcgtctgttgcatatcccataagcgtcatcacaacctttgaggttaccttgttcatcagattgtttgtgaccatatagtcattgatatttgcgaggaatacaacgcccacaccgctctccggaagcagatacatgtctgagatatagttttccgtaagacctgtatgattgtacactgtctcgacatatttatccgaacgtacccagcccataccatagcctgtctcaccggactcatccataggaactgttgcccgaaacattgtgctaaggctcttgtcagagagtattccatagccgccacgcagatacatctgaagatattttcccatatcatttgcgcttgatgcaatatagcccgccggtacagtggaccatgaatcgctgagcggatacttcacatcgctttccaccgaaaaaccgaaataattgttgtggcctgtaatcagaccatccttcttcgcttttgcataggctgcgctgctgtgagtcatgccaagtggtgtaaaaaatgtcgctgtcagataatcgctgtagctaacacctgatactttttccactataagaccaagtatgtcataattgacattcgcataggtatattctccatttttgccaacaatctttgcatttcccacatgctggtacacgccaagtccactggtatgattgagcagctgtcttattgtaatccttgtcgcatcctttggatttttgaatacctcagctgcatccagataaggatttaccgggctgtcaatattcagatgtcctccctcatacagcttcatgatgcatgccgcagtaaacgacttgctgagtgaaccggtgataaacggtgtgtcaaggctcttgcactccccatatgtaccggagaaaagcacgccctctgcatctaccacctcaacagccatgcccggaatcctgtaattgtcacaggctgcctttaaggtatcctctatctctgtatatttcggcgaataattgttgttgtcaagccttggaatcatatctatcacaagacccactataatagcaaccactattcccatcagagctctctgtggtatcagcccgatataatgtgcataattggtatatgtctttttcgccatatcctcggtaccctttatccacaccttcggtgtatgtgcataccagccacagtatactaccagttcaagaaacaataggactgccatccatatcaaaagcgcaaacacaaagcccgttgaaaagcttgttgcccccgctattgatgtcagtatgacaagcgctatcgtccagaatataagtgtcggaagcttctttacaaacttctcccagtctgtcatgatacggatattccgatttctgtagccacgcatatgcatgacctttttctgcagcttctcgggcatattgcttatcttatatgccggatcccgctttatccgtattactctgtatatgccaaatattaagcagcagactattatctcaactgccagtaccattctatcaaccaccttatgtcttatttacagtcatttgagactgtactttatataaaaatttatcacattttttgtgctatgtaaacacaaaataatatgaatattacgggccgtaagccccacaaatcggtggcgcacacggactccccttcgagctacgctttgctgttaagtggctgtacgaattatgctttttacattttctatgctcgacgaaaccgtcgaaactcgccctccatggctcgatttctccttgccctgccttccatggccgggcatttctgtgtttctatgcataattctacagccactaaacagctccgctatgcgctctcacgggagtccgtgtgcgccaccgcttcgcggggcttacggcccttaggttgtggatttatttacttcgtaatgggcataagtgccggtttccggggtgcacatgctctcgtgagagcgtatagcggagtcacttagatactgtagaattatgcttcacacgcaaaaatgccccgccatggacggcggggcaaggcgttatgcgccacggatggcgcataaaagccggttttgtcaagcatagaaaacataaagagcataattcgtacagtatcttagtgatgcagcgtagcgaacacgagagcatgtgcgccacgtaaaccggcacttaggccacgtataacagctacaaatcagttctggccatagtatgcgttagccccatgcttacggtagaaatgcttctcctttatgttgtccggggctggcttcacatcaggatttactgactctgtgagtctggccatctttgccacttcctcaaggacaacggcgttgtgcacagcctcagccgcatcctttccccaggcaaacggtccatgattctgacagagcacagccggtgtgtatacaggattgatttttctgttctcaaaggtctctatgatgacaaggcctgtgtttttctcataggcttcgttgatttcctctgtggtgagatttctcgcacatggaattgagccaaggaaatagtctgcgtgagtggtgccgtagagcggaatatccctgccggcctgtgcccatgcaactgcctcaggtgagtgcgtatgtacaattcctccgatatccggatactttttgtagagctctaagtgtgttgcagtgtctgacgaaggcttgtattttccctctatcttatttccttcaagatccatgactaccatatcatcaggggtgagcacatcataatccactccacttggcttgatgacaaaatagcctgtttccctgtcaattccactgacattgccccatgtatatgtgataagccctcttcttgggagctccatgtttgcttcgtaaacctgtttctttaattcttcaagcattttttgttcctctcttattattttttactgctattacagcggaagcgcctttaccatggcacgctctgcctcaattgctgccttatatgtatttatgtactcatcaaagccctttacatcatcagggtccggctgcattactatgcccttttcgccattaaataccctgtctgaaagatatttttccaaaggctctccatctgctttattcaccatataagctgcgagcactgccatgccccacgggccgccctctccggctgtctccatgaccgcaaccggtgcatccatggctgctgcaagtatgctctggcccacaccctttgtcttgaacagaccaccatgaccgtaaagtgtgtctacctttactttttcctctttaaagagaatatcacagccgatttttagtgttgcaagacttgcatagaggtgtgtgcgcataaagtttgcaagattcatccttgcatccggctttctggcaaacataggtctgccctcgttgagtccgatgacaggctctcccgagaaaaggttaaaggctacaaggccgccaccgtccttatcggctgtaagtgcattgttgtagagctttccatatatgtcattcatatctatatccatgccaaacagctctgaaaattccttgaataatcccacccatgcatttaagtctgacgtacagttgttgcagtgcaccatagctaccgcatctcccgatggtgtggtgaccatatcaagctcctcatgaactgccttaagcgccttttcaagcaccaccatagcaaatacagatgtgcccgctgatacatttccggtgcgcactgcaacagaattggttgcgaccattcccgtgcctgcgtctccctcaggcggtgcaagcaatataccgctctccagattgccgcttacatcaagccttttagctccttcctctgtcagcgtacctgccttttctccagccgtaagcacctttggcagaatgtcccttatatcccacggatattcttttaccttatctaatgctgcaaatttatcaagcattgccgcatcataatccctggtcttcgaatcgataggaaacatgcctgatgcctcaccgacacccatgaccttttcacctgtgagctgccagtgaatatagcctgccaatgttgtgaaatatgatatctttgatacatgctcttctttatttaatatagcctgatacagatgcgctatgctccacctctgcggaatattaaagccaagcacctcagtaagctctgctgcagcctcacctgtgatggtatttctccatgtccgaaatggcacaagcagattatcctccttgtcaaaaggcagataaccgtgcatcatgccggaaataccgattgccgcaagctttttgatggtaactccatacttttcctttgcatcctgcgccattttgctgtagcagtctgaaatgccctcccaaatcatatccaggctgtatgtccagatgccgtccacaagcatgttttcccaatcatgggcacctgtggctataggagcatgatcctccccgataagcaccgcctttattctggtagaaccgaactctattccgagcacagccctgccgctttcaataacactttttacgtctgacataatatacctccaccttgtaatgtaaatttctgaataattaccttaaattattatactgtaattgtacaacgttttccttcaaaagtaaacacaagaaaacataaatatacataaattttaaaacgttttcaaaagtgttcaaaagtgaatatcactttttttattaaaatttcagattatattgatagaatgtaaaaattatgttatgttatatgtgttttgtgtaaactaaatatgtataactggagcaaatagtaaaacaaattatttttacaaacggaggtaaacatgaacatttactctatattgcagttatgcggtggacttgcctttttccttttcggaatgcatgttatgtcaggcagtcttgagaagctcgcaggaggcaatctccaaaagatacttaaggaggtaacctcaaaccctatcaagagcttattttttggagcaatagtcactattgcaatccaatcctcatccgcacttactgttatgcttgtcggactcgtaaactccggcatcatggagcttgcccagactgttggtgtcatcatgggttccaacatcggaaccactctcaccgcatggattcttagtctttcaggtatcgaaagtgacaatctgttcatctcgatgttaaagcctgagaacttctcccctgtcatcgcgcttatcggtgtgattatgattatgggaagcaagaaggaaaagcgcaaggacgttggaatcatcatggcaggttttgccgtacttatgtatggtatgcagctcatgagcggcgctgtatcaccactcgcagatatgcctgaatttaccggactgctcaccacctttaacaatccattcctcggagtgcttgtaggtgctgtatttaccggagtcatccagtcatctgccgcatcagttggtgtgctgcaggctttagccatgacaggcgctatctcatatagcatggctatcccgatcatcatgggtcagaacatcggtacatgcgtgactgcactgctttcgtcaatcggcgtaaacaaaaacgccaagagagtatccatcatccacatcagcttcaatctgttcggtacagcaataggacttgtagtatactgtatcgcacgttatgctgttgatctggcattatttaatgacagcatctctcctgtaatgattgcggtattccactcaatcttcaatattgctaccactattatccttctgccatttagcaatactcttgtaaagattgctaagaagcttgtcacaactgacaacgcagacggacaggttgtactcgacgagagacttttactctcacctggacttgctgtcaaagaatgtcttgagaagacaaacgagatggctgagcttgcaagagacagcttcaagaatgctttagatctctttgacaattactcagattcaaagtttgatgatattgaagtcatggaggagcgccttgattacttagaggatcagcttgacaccttcctcattcacttatccggaaaggatgtttctgagggcggcaacaacgagatttcaaagatgcttcatgcaatcaatgacttcgagagaatcggagatcatgcgataaatatggcaaagcttgccaagcagattgatgataacaagcttgaattttcaaagaacgcaagaaaagagctcacggtgctcaacaatgctctgcgcgagattctcactctcactgtagaggcatttagcaaaaacgatttgacagaggcagtcaaggttgagccgcttgagcaggttattgacgatctcaccaaggagattagaaattatcatatcgagcgtcttcagaagggcaaatgtgacagcagactcggcgtattcctcacagattacatcacaaactgtgagagagcttcggatcactgctcaaacattgctgtatgcctgattcagacacacaactcatcattcgagacacatgattatctcaatgagcttaaggccggacaggagcctgcatttgtaggtcagttcaccatgtatcaggacaaatatcatcttgatgaggattataaaaaagcaaagagtaaaaaatcatcgaaataatataacgtaattaaaaagcaggatttctgattaatttcagaatcctgctttttttcatcgtctggatatgaaatgcttcacaatcgtataaagcactatgatgcatgcgaacacatatcccatcacaccaagcgccggtattccaagtatcttaggtgtcatatctgtggtacacactatgcttgagctgattagaagtgccataacccataagcccatgacgatatttctcaccagcctgtgtaaaagcctcgcaagctcatcagaagcatgcatgtcaaaatttatgcgtgtctgccctctttgatattcctcgagtatctgcgccattctctccggcagttctgccatgcggtgagctgatttgtatgctgtcttcccggcttttttaagctcgcccttcaaatcaaaattcttaagcatctcctgccttatccttgcagaagcaatctctaccatgttgatgcccggtgcaatatccgcaagcacgccctctatctgagtgattcccctagcaagcattgtaaaaccgtgcggcataacaatgcggttgttcttcattacctccaaaagttcctgaataaactctgcaatatcgacctgccccatatccagactgccgtatttatttatgattatcttgatatccttgtacagctttgccctgtcaggctcacccttaaagtcaccaattgcaagcaccgcatcctctatcatgccgatatcgttcatggcgatgccgtaaacagcattgctcagttcctttttgtcatgctcagaaagccttcccatcatgcccatatcaatccagacaattttgccatcccttatccttacattgcccggatgcgggtccgcatggaagaagccatcctctatcacctgcctgatatagttgtcaatcagcttgctgcctatctcctcaaggtcatagccatcctttaaaagcccctccttgtcatcgatattaaagccctttatatactccatgacaagtacatgtgatgtggtatacttgcggtaaagctttggtgtggctacaaatgcaacatccctgttattgcaggcaaactcctcaatattggatgcctcaagcaggaaattcatctcctcctgtgccacagcccacatctcatcaagcaccatgtcaaaatccacaatgccctttatagagatgggcggcacaagcttaaccgccttgtgaagcaacgccatatcctttgacatcacctcgtgaatgcccttcctttgcaccttcacaaccacctgctcaccggttttaagtgtggccctgtgcacctgcgctatggaagctgccccaagaggctttttatctattgaagcaaaaacatccttccatgaatagccaaatgaagcatctatgacagcctccacccgctcaaacggcataggctccacatctgagcatagcttcataagctcctcgcaatattcctttggcagaatatccgagtgaagcgacattatctgtccaagcttaatataggtaggtcccagctcctgcaatataagtctgaatttttcgggtgtaagtccatgcgtgagcttgtacttcttcagtaccgctgtcatctccttcaggcggccatccatactagttcacgctttcctctttatcgtcctcagcttctatttttatatccgctgtctgtgattctccaccggaagcactttttccatcggctgaagtatctgttacaatgtcctcatcctcgaaaacgctttcatcagcttcttgatccacgtcagcctcatccatctgtgcaagcttgctctttagagcctgtatctgttcaggtgtcatcttgtccaaaagctcctcgagctcctccggtgactgtggcttaacagatacatttacatttttctttactgtgtccttgatattgtgcttaagctcctgattgagcaccttgccctgctcgacagtcagctcacctctcttgaccatctcatcaagcacttcctttgatttctcagcagtcactgccactgttcctattcctgcaagtaaaatcttctttaatccgtctgtaagtctttccatggtaaaatcctccgtttcctgttatttaaaattgattgccgtaatctgactacacctttaatcatcataatagagaagcaatccttggcacaaaaatgataagtccaactatcgcagccattattgctgccacaagcactgctcctgctgccgtgtccttagctgtcttggcaagcggctttcgctctgtcgttaccaaatctacaactgactcaatcgcagtgttgaccagctccagggctatcaccagtccaaacagtgtcaggcagatgcaccactcagtcggtgttatcccaagtaccgctcctgctatcactacaagtatcgcgacagtgcagtgaatcttgatattgcgttcatttctgatgcatgtaaatatgccctcgaaggcatagccgaagcttttgtacagaggtggtttctttgcttttttcatgttgatacctctcgtgatttaattttggaattagttttgataccttttactatggtactattgtataactttttggttcaaaataaaagaggattgtgcaatattgttcaaaaaatagaagttactgacattttaaataattttattactaacactttgccagcactttaaatattccttattgacattacgaatttatcgtactaacctaaacacgtaaaatatatagttataaaggtaatcagatatgacaaatttacattcagataaaataaaaacagtaaacctgcatactacaaccaatcatatttatacaaatactaagcttcgaaagcttttggttccgattataatagagcagctattagcctctcttatgggaactgtggatacaatgatggtcagcaatgtaggttctgccgctatctcagcggtctcgcttgtagactcaatcaatatccttgtcatacaggcactttcagcgcttgccgccggtggtgcgattctctgttcacagtatctgggaagtcacaatacaaaaggtgcccgccatgctgcaagacaggtattttttgtcatggcatttctgtctgtacttttatctactttttgtctgataacaagaaagtcgctgcttcgtgccatatttggcgctgttgaagctgatgtaatgaggaactcacaggtttatttcttttttacattgctgtcatttccttttataggtctctatgatgccggcgcatccattatgcgcgcacagaataacagtcgcaatcctatggtcatatctgttatttcaaactttatgaatatcggcggcaacgctattctgattttcggcttcggtatgggtgttgagggagctgctatttccactctcgtatcccgaatattctgcgcgattgtcgttatcatacagcttcgaagagaaaatgaaccgattttcataaagaactatatgtctatacgccctgaatggagcctgattaaaaaaatcctgctcatcggtatcccatcaggaatcgaaaacagcatgttccagtttggaaagctggctatccagtctactgtatccactcttggaaccgtggccatcgcagcccaggccatgaccaatatcctcgaaaacttaaatggtattgccgctatcggaataggaataggtcttatgactgttgtaggacagtgtctgggtgccggcagaaaggatgaagctgtctactatatcaaaaaactgtcactggtgtctgaggttgtaatcattgccagctgtctgattattttcatactcacaaagcccattacaatgcttgccggaatggaacctgccagtgcacggctctgctttgagatggttacctttatcacaattgtcaagccaatctgctgggtaccatccttcatcccgccatatggactgcgtgccgcaggcgatgtgaaattctccatgattgtatcctgctgcacaatgtggctttgccgtgtaagcctgtgcatatacctctgccgtgtatggggctttggtccgattgcagtgtggattggcatggcttgtgactggatgcttcgttctattatatttactgccagattccactcaagaaaatggctgaatcatcatgtgattgattgataataacaagctatactatgctctattcacaaatctgtataatataagtaaaggaaaaacatgaaaaactatcaaccggactattacaacaatttcaaatgtattgctgacaaatgcagtatcacatgctgtcaggagtggaaaattgcagtagatgacgctacaaaccgcaaatggaagaagctttctcctccggatactttatctgcagccactttttctgctgataaagtatctggaaaaagtgacaatctaagctcttacacatgccataaggatggcagtctggttattaaactggacgaaaaacaccggtgtccgtttctttcaaaggataagctatgtcatcttgtaatgacatactcagatgaagtgctttcagagacatgtgcactgtttcccagagagatccaccggttttcaagacatgaggaacgaacactcatgccgtgctgtccggccgttatcgacctgtggtgcgaaaaacctgtcacatttcctgtaatatccgagacccggaataatttatctccggcatttttaatccgtgataatctgattaaactgatatctgaccaaaggctttcagtggaactggctttgcttgacgggctttacatcttattggaattatataaaaaccagccaatcaccaatgcacatatacaggaatacttttccggacaaacgcttaatgaactgaataccgccatggaagatatccatatcccggacgaagatacatttatcgaatgcaatgagctgcttcaggatttatcagtaaattatcgtaaagagggtttatatacagcctttcttcagcctgtactgaccgaagcttgtaaatactccaatatttattcacagtcagacaataattccataagccgcaccttgcaaacatcgcagaaacaatttggctcaatactcacagattatgacattgtttttcgcaattatctggcaaacgagctgttttccgacctgatatcgtctgaagcagcatccactaaaaaaattattgaacacatgattatcaaaatgcagtggattatgattgaatacactgctatacgtcaaagtcttttcttgtggtacagtcacaatgccaatagtccgttgacatatgaaaccatcagagagcatattgtcatcatctcacgcatgacaggatatgatgatgatgacatacgcgaatatctggaaaacagctttgcagagctcatatgggattggggctacgccgcactcattatgggaattagaaaataattacaaaggagatttttactatgagagaaacaattttaggcaataatatacgaaaggttccttcagttgcagttggatgcatgcgcctttctgaaaaatcaaaggatgagatgaatcattttattcatgctgcgctggaacagggcgcatatttctttgatcacgctgatatctacggtggcggtatgagtgagagcgtattcggcgaagcgtttgcagacgatccatccctaaagcgtgaagatatgtatctgcagtcaaaatgtggcatccgccaaggcttctatgatttctcaaaggagcatattctgaaatccgtcgatggtattttaaaaaggcttcatacagattatcttgatcttctgctgcttcatcgtccggatgcactcgtagaaccggaagaggttgcctatgcatttgatgttctttttgaaagcggaaaggttcgccattttggtgtttcaaaccataagccgatgcagattgaactgctacagaaatatgtccgccaaccactcgttgtcaatcaggttcagttcagcattcctgtttccaatctcgttgcaaatggcatggaagtcaatatggaaacaaccggttcaattgatcacgacggaagtctgctcgactactgccgcctccacaacattactcttcaggcatggtctccgtttcagatgccggcatggaaaggctgttttctcggaagcgacgaatacccggaactgaataaaaaacttcatgtgatagccgaaaaatacaatgtcagcgatactactattgcggccgcatggattttacgccatccggcaaatatgcagattgttaccggaacttcaagcgaaagccgcctgaaggaaattatcgcggcatgcaatattactctgactcgcgaggaatggtatgagctgtacctggcggcaggtcatatacttccgtagaaattatcagcactatttttcaaagtgctgataatccttggaatgcgtccaatcgcctccccactcaaaaccatgctccgtaaacagcttatagcataaatcatcatggtcaatcttgtgcgaaaaatccttgctccggtcaacataatctgtggcatttgcaggctcaattgaaagctccccatcaactgttttgacataaggattgtatagagtgttgatatccaccgccattcccattccatgcttcgatatctttgtagtgtgggagataaatctgaaattgaaggccgatgaattattgtcgctcatagatgcctcatcatctgcatcatattcatcaacgagtctgactttttctatttgatatccggactcatagagctccataaatatttcaagtacatcatctgcgatatctttatttacaaccagctcaccttcatgcacctgattgtcaaagcctacgtgtagtacatgtatatatcgcagattttctctggggagtgtacaatctgccttgtaggatttgccctgcattttttcaaaaatattatcaggaatttcggatatataaaattgctctttattattttcataagtctgtttcaggatctctgtttcagatgtactcgtgtcagatgtattcatatcagctacacacgtatcagatatacttgtgtcagatatacttgtgtcaggtatatcttcacatgtattttctgatacattcgtagacgatttatcattagactctttcttatgatttttaatgaattctctgcccgcaagtgtgacgataagcagcgatgccacggctgtgattattatgtttgtgtgtcttttcatattggttttatgcctttcatattgttcgaagcattactatattgtcattattgtgtgtagttccggtggcttgcaggtttgtttactattcagagaataatcatctgatagtttgcaagtccacctatggaaattataatctccggacgatgtttctacaactagaaattttgaggtactaatggatagcatcattattttccatatcattcatcaatttatcaaagtcactttcatatagtgaatcctgtataactctgtatttctcaaactcactttctgcaaattcctttgcaatagctgctgttacttttcctttatcctgaagtacatcagcatcattaaatctaagaaatgcgtcaagctttgttttccaatcttccatagtcataggaatatgtcttcgtgcctgtcttgttgcataatcaagatacattgtcacaatctcatttaattctgcaagttcttctttttccaagtagttttttgcaattgacacatctgtttttactattttaccatcaggcgcatttttccatgatttaagtcccatatgttccttattatgatcagctcttgccactatcacttctgccgctgtattaccatgaactgcataatgcatcttattctgaactgttgcataaaactctcttgtcacctgtgaattcttatcataatcaactgctgttgcatatatgtctgtaattttctggtaaaatcttctctcacttgctctgatttcctgaatctcagcaataagatgctcaaaataatcttcgtcgaaaatctgtccattaatcaatctgcttttatcaagaacataaccctgctttgtaaatgtatccaatacctttgttgcccatgttctaaactgcattgccctctctgaattaatgcgatagcccacagcaataattgcagctaatgaataaaatttgtagttgtatgttttcccatcatccgcagtttgtgcaaattttgcacaaactgaattttcatctaattctccctctttaaaaatattgctcagatgttttgtaatcacacttctatctacatcaaaaagctgcgaaattgctttctgcgtaagccatacatcgccattctgaaccctgacttctattccgtcttctcctgcatctcgagtaaaaactagaaaatccacagtgctatttcttatctgtaattctttgctcataaacgcattcctttctctattctcatgaaacgtcttctttacatcttatggaatccatatgttttagtcctattcagctcaaccattatctccaaatgtaatttccatcaattcactagctatctctttactcaaaaccctcataatactgtcatcaaccttatccttcgccaaaagattaatatttccataccagacaacttcctgatctataacagcaaatcgttcacatgactcttctactgttttaatgtagaaaccagctttgcgcatttcttcatgtagctgcatccagtatgatgcatctccaaatccataggaatccggtgcccatgttactatcgtaatctgaacacctgataactgcttttcttttagcaggttaataagttcataaacttttgtcccactaattgcagggcttgaaataattatatttttatttgcatccagtaaatctttatgataattttcagcataattatcaccgtcatatattgcattagctgtctgtttatcattatgcaaaccacctgcaatctcatatccaatctgtttatatgctttaagtctcttcatatacatgttattaaacattgtaatatggttgtctacataatcatatattattacattttctttaccagcataatcacgattcaatcgaccagcatactgttcaacaactcctcgaaatgatacaggtgttgccataaaaagtgtatccagtcttgggaaatcaaacccctctcctacaagtgaacctgtagctattaatatcagagactccgccttataaacctgatgcatctgttccaaaatcttcttatgttctttctttgagttgttgcctgtcattaaaaatacatggtctgcataatctttcaatcgctcgtacagtttctctgaatgatccttgtatcgtgataaaacaactggggtgcgacctgctgatacgcaattcttcacatcttcaacaatctgttcgtctctgatatcattattatgaataatctcataagcttcatttggatgcatcttaccgataagtacacctcttggtggaacagttctggtaaaacgcggatatacaagatgttgtatcccctgctccatagccttttcctttgctgtgtaactatatcttataggtcctatcagcatataattgattttttccagtccatctcctcttttcggagttgctgtcacaccatatacataccttgcttttacttcttttagcacatttgctattgtttcagaggcagaatgatgacactcatcaattatcacaagtccataatcattcagcaaattatgaaactctccctttttgcaaagtgagccgaccattgcaatatcaacaatccctgtcatcgaatcatgtactccctgcaatgttccaatcagactttttctagttcttaatcttccagttttcgttttgtactggggtagttcttcatctataattaaaaatttgtttagagcatctttccactgttctataagtgcagatgattcaagcaggatcagagtattcactttcttttctgcaattactgcactgcatacaactgttttcccaaatgctgttgcagcatgaagtattccattatcatgcttagtcagttcctttaacgccttgttctgttcaggtcgtagttctccattgaattctacattaatatttcttccctgctgcctctcatcatcaatagtatattcaattcctgccttatcaatatttgctattaattcatcctgtaatcctcttggaatctgtatgtatccaccaagatggtcttttccaagataaatccacctcgaagtatcataattagatgttccaatcgcacgatttttataaaatactgggttactaaaggctgccattctgcgaatcttattttgcatcgcaggcttaagattcgtgctgtcgacatatataccatttgataatgtgatgtccattttcccatcaacatctgattttgcaaaatttttcattctatcccatggcttttccctattttcttcatcactggatgcttcaaggtcatctgctgtaaatgtccattcccttatcttattctccagaaattcctctgaaagcttaggtttacttaataaagcattccattggtcaggataagcattccagttaccatccacaaatgcactattgccatctttcaacgcccttccctgtaatggcaatgcaatcagatttcctattgccacattttctaaggaatcctgtgctggtaacattctgtcataataattgaatgactttaaattcacctgctctgcacctttatctaaaagtgctaagccaaatttacgaaccactgccgccgatattggcttgtcaaagaatatccatatatgtgcaccttttcctgaacgagaacgttctaccaaaggttctatcccatttaatgtgcagatatctctcatagcttcgacttcttcaatccatgtatcatctgtatttgcaaagtcccttttttctgcattcttctcatgattatcaaagtcaaacaccagaaacctacatgttccatcactaaataatggatatacaccgattacatcttttgcagcataagagtttcccctcaaatgcatcaatatggttggtaaatctaatcttgtatacgagcaatatttgcaatccttacagtctatatgtgtatttaatttcctatggcaattatctgaccagaaattatcacactgcggataatatgccgcctctccgtttttatttacatttcttttcgcatatacatctgttcttccccaaaagaatgagaaaaagagctttgccatcctgtctgtaatctctttggggtacacaatccttttaccctgttctggatcaaaatcctctttcgtatcctttttccttatacttgccagttcattttgatatgacaatcctgctttatccaatatattctttaatacctgattctccaattgcagattgttcaactgcttctgcaatctagtcacattctctattggatcacgcatttgtcatacctccctttccgtcattatctattcatctcaagtattctttttacttcattctgtaattcatcactaaagtctgataaatcattatatgtaattactttcagtctaataagacgaacaatatcccatattacctctgattttttcagttccatgacaactcccggatgacgtttatcttcttttatcagtttttcaagttcccagaatttctctgatgcaggctttttatcatcattcagaaaatttgcatactctttaacaagaccttccatataattttcctgccagcctgataatttttctcgaaatagcttccaatcttttttacttatgtccatgatttttaacctcctcagtcttatgttagtctcaacaaacaatttcaaaaatgagactgacttgagactactactttataattcacctgtaaatccgggttgtctgattacttttgcaaactctaaaaaatgttcatgctttctaaaatcttctttcctagtaaaatcggtataacaaatagtcaaagcaacacctagcaatgttattccactacctattaatgaggcatagaaactaatccaaacttcctgcttttctattggtataaatcctatagatgaaggcgtcgacacccaataatttacaaatggaggtatagctagaaacaccactaatatgcttacaagtattaagattttctttttcactttttattcctcccatatattttattgcacttttccgatgatactatctataagaatatgtattaacctaaccacattggttaagatgtggttagcttattttcttacgaaaagtatttctgatttttacttgatggcttttccggtatagtcatctttaacacaccatttttcagcataggagttaaatactttcttctaaagcttgtcctgctatcaaaatcaaattcatccattatttctttgaccgacttcgggtctttacaaaaatcgataatcagcttattcacatcctgaccattttggttaggatgatgctcaggatgctgaccatcatctctcaataacctcaaatacctatcacaagccttgcaaagaaccataattccagcctcattaatctcgtattccggcaatggtccatcatacaacgcacaagcttccctaatcttctcaaatcctcttccccacgcttcaatcataccgcttttgaaaaagatattagccaatttcggattataaggctttgatgaatgcttcataaacaacttgtcagtagaatcaagatttggaggcatctcaccatcattccaaatatatatcttgtccttgtaaacgctaatctgaattggattgcaactgctgtaatccttatgaacaatggcattcaacaaaatctcacgaaatgcgtccttgtgaaacataaactgctcaattctctggacaccctcataatcaatcaaggccttcatatattttgtataaactaaatcaacggtcttatctacctgctctatcaaaggaccgtgcacctcatcctggtacaccaaatccgaatctgattttccaaaatagccgattttgatataagagcctgttacccacttctctggatctttataaaatgcaagcattgctgctcttatcaaatatccatcttcatcaattaggtgcaggttatccatcaagatagtatcttccacactgacttcttccttcgtaagccttccccttttcactgccttatctttaaataactgtattgcatcttgctttaagtcagatactgacagttttggcagaggcacaccatcccatgttcttccctgcgtttttaacaaagctctttccaattcctttccggtaatctcacgcatggtacttccggaacgataataatatttcccatgaaaacttattaaagatggatatttatcaacaattatctgcagatactcaagttcacctttatataacaaatttacatctacaatgattcccattgtgtccgtaattttattaggaattctctctaataaatcccttgcattatcaatacctacaacattaccatcgtcatccgtacctatgtatattgttccaccataggcattggcatatccacaaatccattttaaatactcatcctgccatgactccttccactctatggattgatgttctttttccttcatatatccaccaactttccaaattactgcttgtccacttccgtaaagaagtattccaatgtatctacaaacatatttgcatcaaataattcttttatctgctcccgattcatccatgcaacctgcgccacttcatctgttgtggcattgcctaaatcaacctctccatcgtaatcaaacagccaaacatccataatatcattataaatttttccatctatgatttttcgtgtctttgtaaaaagcacttgtccattttccggcatcaaatcaatgccaacctcttcctttgcctctcgaattactcctgataaactatcctcaccttttacaaccgaaccgcttacacattcccacatcaaaggatgtgttggtctgtttgcagaacgctgcgagataaggtactgtccattagaattacggatccagacatgcaccaccagatggtatccgtctatcggtaactgttctcctctgatatggtcttttcccagaagctcccggttctcattatacaaatcccatatttctgcatccggcacatactccacaatatccccaaaatctgcatgtaaggttttacagattttgctaagaattgtaaggctcacctcttcatcacggcgaagctttgtcattgtgttaggagcaatttctgcctttttacgcaaatccgatttgctcatttctttatccactaataatttccataatcgtttataagatacagccatggtaatttctcctttttcttttcacgctatcaaaccaacttatccagcatctctacaatcttttctctttcaccgctaccatttgttttaaatctcagtaatggaatttcgtacagctccattatatgatttttcaataaatctcttgaagcctgaatggtatcctctttatggtattcatatccatcaacctcaatcgccaacacaggctttttaccaattctgttataaatcagaaaatctaaatgtgttgctggattcattgcatactgacattcctgctcatttaatagttttggattcttaatcaacatattcaacggaaaatgacaaacaacatccaagcttgaataattgttagcagagataatgtcctctatcaatgaatacatcagattttccgaatcatattctgatacttttttgtgcttctgcaagtatactcttctttcctcagtatactgcttgtaaaggtaatcaaaaatcgaataaatcttgctttcagtaacctcaaaattattatactgaatgtaatcaatcaaatctgttatattgtgctcttttgattgcacatttccagttacaaccaacatcaatttctttttggctcttgatacagcaacattgattaaatatggatcatctgcaaaatcagatatttcatcatccacagtagatatgataatatcctctttctccttgccctggaacttatgcactgtagcagcatcaatatctgttatctccttgcttaatgcttctacctgatttttgtacggtgcaataattccggtttcttccggatttgaaacatattttggtataatctcatttttaataacatctatctggcgctgactataatggttacgttcatgatttcccgctaccgtttttactaccgataaaacatcctcttcacccttatccgttgtcataataatcaattcaccacgatagaatttctggttacagaaatttattatttttgggtgacacctataatgttcccgtaacaatgtttgtgttacattaggcataacatccaaaatggattgcagaaaactgtttgtatactgatatccttcactcacattaaatctgtcaaatatagcttttgctttggcctttatatcatctgtaacaacattaggaagttgcttggtatcacccacaataacaacattccttgcacaggacaatgccaacgcaccggttgcaatatctacctgtgatgcctcatccatgataagataatcatacaccacatctgaattcaggctgtttcttgatgaaaatgttgtacttaatataaccggatactcagccagtacattgtatggttccttccacaaattatcttcactaaaagtttttctactactgttaccttcatatttccttgccagtttgtcttttaggacaaccattgactgtttgcataaatcctcaagcaaattcttattaacactatttgaatacttttcaatatctgcaatttccgcagacaactccgcctgctttgcacgataatacattgcctgaaaggttgtaattatctttgaaatatcctgcttataaatactccaatcggttactccatatttaaataaagcttttatcttaaaccaaaatcctattgccgttttctcttctgaaatcaactggcactcctgccacaataccatccattgctttgaagatagttttttcttgaacttaatactatctgtatgaacatctgattctttaacatattgattgaaatattcctgttcagtaaccaactgtgaaagttcctgccttaaacacgctaattttcctgcttatcgaaaacactttttaactgactggattgttctgctatttccttctgcaaaacacttggatcttctcccgttttccacgacgaaaagtcgggataagcagcgtcctgatgctcaacaaataatttcttatttttagaacttcctaatgtcgcagcaataaaacctaaattgtattttggagaagataatttttcatatacgttttccgttgccgaattattattggatactatctgtaccgttttcccttgcattaatatattggcaataatattcaatatcgtctgtgtctttcccgttcctggaggtccctgtataacactaatctgattctccatggcattttttacagccttatactgactgttattgcatccaaatgggaaaatcggaatgtattcgcgttctgttcttttcccttgcaatgacgatggattcaaatactttgctaaggccacatcactacccacaaaagaaatcttgtcaaacttcttagacaataatttttcaccagtctcttcattcttaagattactcaaacctgcaatttgctttatatattcaaatacatttgatgactgactctgggcaagacatgactctataatatgcaagtcgttccgacgataatctctttcactaccatcgccaaaacaaatgtgccaataagactcccttccgcttctaaatacatatattgcattaacatcaaagaactctcgtccttctctgctaatccgatacatgttaggattcaaaacctccggatcagtcaacttttccacattcaaatatgcatacgagtatgtttttccattattgaattttacatcccatttttgggtatttctattgtaaccacatgacattatttcggatgtctttatttcacccttgataatgaccatataatatcgtgtattcatctattcctcactactttttatccgcacgctacttaactttaaatttcttctctatataacaatgttcctgtttgccaatcagcttaaaactgtaactcggacattcagattccatttcgttacagctgctttcaaagtccagttcgataatatatggcatccagtcaataattcttaaaaaatcttcacatccaaaattattgtcataaaaattcaatatcgtactaagggcagtaccatgggttcctataacaatatctttatccgtattatctgataaaatctcattcagtgcctctatgttacgtttttgcaccatagcaatggactctccaccttcttcatgataattatgatcagcccaccgttttcggaacattccgtggttgtttccatcaagtcccttttcacgctccctcaatctctcatctgttataatctcttttgtgaaaaaatctgctgcctctgtaattgtatccatgctacgtttatacggactacaataaaacgcatctattttcttatccttcaaaaattccaaaacaattgcagaatctttcttgccttcttccgtcaaaggtcttgttctgtcttcttcccaatcgtgttccggctgtgcgtgactcacgaaataaactcttgtcattttatcaactccatttcatcttccatttttacaaatccatacttttcatataacggtcgtcccatctctgtcgcctctaaagcaatctgtgatacgccctgtttccttacatcctttaccagtaaatctaatgtatgaaatgcaatcccctgtctccgatattccgatgctgtatacatattcataatataagcctttttacctgttggattatggtaggtcggcataacctgataaaagctgacaccacctgcaccgacaaatgccccgttatcatacaccagatatgcaacatgctcacccgtttctaatgcactcttataatactcataggattctttttccactaatgacatatccacatcattcgatagtttgttagctgctcgaaggacgataattctagtttttacaagttcatctatgtctgctatggttgcttttttatatttatagttttttgccatcacatactactcctctaaatctgttaaacttttcgtaaaacaaataattctatttgcttccgcaaaccccattttcaaatgaaacttaagactatcttcattatccaactcacagtcactcgcaaactcaaggcacccctgatcctttgcccaattctgacattctcctaacaattctttcgcataacctctttttttatattcttctaaaacaaaaatgccttccaaatatcctaccggactagaatcagttccctctacatagtcaaaccttaatccgcattgtgcaaatccaactatatgttcctctgatatagcaagaaaaataatatttttaccttttcttatatgttcgcaaaaaatctttgttaaatcttcaactgtgtgtgatttccacatttgaattgccaagctcacaagttggggaacatcctctaaagtagcttttcgaatcaattttaccacctatccttaactctttctgaaatatttgtaagatacaataaaccacttactctatctggttacaaaattctataatttcttctttcctacagtccaaatcttccttatattccaccgaacacaaaccaagactatcacaacattcaatttccatatgtccataaaaatgttctatggttgcaataatcctctcacattccctcattcccggtccagttcttaatgcgataacatatcccttcttaccactacttatcttggcatgcggttcatgtgtgttacaccacggagtgcatctatcaataaaagatttaaattgtcctggtacatctgcccaatacgacggagagacagatataacaatatcagcccattcatattgctcaattatcctatcaacatcgtcattctgaacacattttgctgtattatgacaagttctacatcctttgcaaaattttatatcataatcatcaatacatatatttttaacatcatgtttcttttccagacgagcagtaactatattaacaatttctgctgttgctccatttcttacaggactacaattcattaccaatactttcattttgacctccgctttcatgtaccatatttttatatgatatcacagaatcactacatcatcaataacaatcgcaatatcttgcgattattgcgattatttccctgtttgcaatatataattcaggtacgtaaagtgaatcgtggatatgcagaggaatcattatttcatagtgcgtaaatgcatggtttggaatccttcttaagaagttatatgaactgcacagttattcgccagtctgctaaaaaagtgcaaaaaattagagccagcctttcaactgactctgctctaccccaaagcatattataatttactctcgcattagctttttatttctactcatcaaataaaaattagtccccataagatatacaccaatcctcttcttttgattatatgatatcttataggaactataattgcattggactgttagtccaaaattttatcccactctgcttctttaaaacctatactctgtattcactctttaatctcccaatgaccactgtagccgtttcctttcatataaactataaccagttatactataagcaaggttgaccggctaccgcaaaataaaaccgaacctgaaaaattggctctattcgaaactatttccccactctcaaatccgtatgtttcaaaggtttcttgacactatgagtcaaaatttagagtcaaattttactaaatcggagtgaaacatccccatttcatccccaatccaaaataaaaagccccacaaagcccataaatacaagctttgtgaggatatgttctctattcaaactcaattttggcaactatatattgtatctaattaaatcacaaacatctatatttggtatgattattcttaaaattctacatattctttgccgtttcggaactttttgcaagcattttgcaatcactacaagtttcgttattttcaaaatgtcattgtttatggtttataataatatttttcagcatctgccattgtatttaccataaaatcttcattattcaatgctgatataataacgctcttagtacatggaatatgcaatgtagctaccgaagacatattatcacgaaaagccggcaacttatcccacaaatctttaatctgcttcttgaaatttccattactatcaactatatctgacttcttgtcgtaatctggataaattacaattaccggtaaaccttttgtacctattccgtaattcatttcctccctcaatgcacgactattggcagtaatggaacttaaaaataaaataatgttcttagaattgtcaagtcttgtatgaagtctaggcttaagagtcttttcccaatcactaccatctcgcacattatatgtcttatcatgtgcatcattaaagggaaaactattatcctctcctttccacattcttaacatattgtagtaaacaaaatcatgtgttgaatttgcccctaaattactttcgctaaatggttccgaaacataaaacgcactataatttgcattttgatatgacatattaaatttctcctttactatatgtctaatgttactttatctttatctcctttatatataacaacatcaacttctccatgtattttatctccatacaattgaaataacgatgttattactctcagtgaatcattatgtgacaatcctgctctcgaaaggtttgttcccatcaatggaattaccaatctatgcccttggtcatgttgatcgtaaaaattaagaagtgactttatgcacatttctaaatcatcgacagaagtatgagcgatattatctttatcgtattccgaaattgcaagtaacaaaaaggtactattgttatttcccctaatcatcgccactgtacctaactcatatacttctcttttcccacgttccttatcttcgtcagcaataatacttttgggcagtaaattttgcatttccaagcaattatgtatcttgttgtctatttcttctatagtaaatcccttattaaccattgtttttatccatcttccatgtaacaaattaggtgataccaatggctttgaacatgttgatatatcttcatctacaatagtgtcaaaacatgaattaaccggaattacaaataacttttcttccttgttccttttgtcaaacccatctttcataatatcagaataacatacttttattttcccagatggactttcccaaattgtctttgttctcttaaaaatacacgtccataggattgcaagtatgagtgcaagcacacataataatattattatcacacatttatattgcgttgacgtaatgcgtatatcatcccaagtccaaaacaaaaagaaaagcgataatatacttgcaaatgtgccaatacacttcatccacgttttacctatgaactccaaattttgttttatcacattcactttgttcataatataacttttgtactctccttatactactctatttgttcattaatctcctcaatccacccactgtcatcactctcaaacagctttatgaactttccaaaattactgctgccagtaacagaatcatccgaatccaaatctttcactcgtcggctcatatctttgtaattcttcacagtaacatgttccataactttctgaatctggtctgctcttcctttgtaattctccacccctgtatattcctttatcaagggagcattcactggttttgccggagatttcagattttcatcggtccaatgtttagatataatctgcatcgtacatggattaccaaatataatcacttcattcgctgcactatccacaccatgaaactcattaattttgcgtttaatgtcctcatactgctcgtgaggcttcttctctgtatcacaaaatacaagtacaagttcatctgctccattttgatatcggtcctgatacctcgctgggatattaccatttccaccggcattgaccaatgaaatatcatattgctcattccatatttttaaattttttaatcgatttagatactcatattcctcattaccttcacagataatacagattttatggttatccaaaaacttagggagcttatttggcatcggcatcatccccctttacaccacttttaatactaagcaatgagttaatcaattcaggatcaggtaaagcgccaagcgcacctttcctatatttttccataacatctgtcgtatctcgtactccctgctgagctgtaaaatctgcaagtgaatatacatacaccccttcttcatccttatgaacaaaccaaatctgctcctttcgaaacattctcttgcaatccataagatttatatcatgtactgtaaatatcatctgtgcacttgtatttaattcattattaaacatcgcaacaatcgccctggtgagcttaaaatgaatactgctatccaactcatccacgactaaaatcctgccttgttcaagtgcttcaattacatagctggcaatagctgcaatcttctttgttcctgtggagtcaaacatcatacttggcacatggactcccttataagtagaaaccaatctgatttgatccataatgttctctggaatatcaagcactttctcatctggcttttcgtcaccttcaccagttttcaactgtatcttatccatatccacatattcaaaattatccatatataagtcagcattttttatgaactcaacaaccttttgctgtaactgattcttattcttcataagttcaatcgtgtgctgcataggtatgttattcatattgatgatatcaattttttctgcaaatccgacaagaatctgcttcatctcattgatatgttcgaatttacttgtatctaccacatagcatagcaaattattcttcgatacaactgaaatcatattctgaacagattcatcaatacactcatatatttcactaacagtatctttttttaaccaacaaacttccttttcgttgttgtactgatctttaaatatctccgaaaatgactcatatatatattcttctttttctgcatcatacttaaaatcataagaaaactttcttccagatgccataaatgtaacacctaacttgcatacatcactatcagtaaatatatttggcatcagtccattcttcttatttaaaagtacatttcttattgccctaatgcacttgattagacatgttttaccggcattgtttggtccatatattcctaccgttttaaggacattaaaattattctctttgtgaacatttgctccaaattttttatttcgcatatctgctttcattgaaaatgtaatatcatcctcaaatgcataacagttttttgctcttacctctataatcatggctcattcctccaagtcacttttcctatttacttatcattattatatcattaaatattttttatgcaactttttttcataaaaaatatttaattctatagatttaacaatatatcatatagcaaaaaggcagctatcaaatcttcgcacattaatacaattttttacataaccaaccaatgtcatcttttcatttaccactatatcctcgccaactctaacaaagccgcatttttcgtataaatgacaattgcctgtttcctgcttaatcgtatctaaacgccattctattgtattcggataaaagccaaataattgttctattaccgtgctcgcaatccctttattttgaaatttgggaattatgaaaataggagatatccaattaacattttcatgcacctttttgccttgatgccatctgactctcacacctccaactttttctccatgaaacacaatgaagtaaaaatctgaattttcctcaataatcttctctgttactcttttcaggctttcttttgccggacttgtatcatcatcttgatatttttcatataatggcataaacgcttctacctgtagtctatgcaaacactctgcttcatcttctgttaccaatttcaatttaattaaatcattcattccatgcacctctttcacgcagagacgagataggctctgcgaatctcgctctgattagcggtcgtcaaatgttcactcgtgcaagcacgatgaccattttcctcgtcgctataacaaaaaaatcgcaccaaacattcattgtccagtgcgataattccaatttacgatgtaatatatattaacacatcacttacattctggttttatgcactagactaatagacctaccggctatggtacaatgattgattttcattggacagccattacatacataaggcgccttatcaagtctgcagcaccgttccttttcgaaatccttacaggtttggttgcaggttggacaggatgtacatttaataccgcagagcatgatttttccacaggcatttgtttttttacagtgatagcggtgtatacaaaagtttttggcattgtagaaagttcctttgtggtaccagtcagaaaggcatcgtgatttaacctcttttgagatagttgtaggatctttacaaaggaatgccgcaatgtctttaaaagtcgcacctttggataattcgttttcgatgtagatacggtcattaagtgttagatgtttctggtttccagggatatatttactcatgataattctccttctactgctgtcagaaggaacttttacaataacactgatgtatgaaagagtaaatatctactgtgcaggactaaattctaccgccctgtagggcagtggaatttaaaatttcattttaggcacctcttcggaggtgttttttgtttagaaaggacttgatatatatgatagaattaaaaatagatagtacaaaaaatgagttatcattaacacatgatgtgtgttgtaatgaacatctggctgatgagttggccattattatcgatatcatgatagcagattattttataaaaaatggccataaatatgataatttttctttggaagaaaaagaaaaaatcattatagaaaaaagaaaagaaattctgcagctaattagtgataagccgtgcacttgtaaagattatttgaaaaattccgatatacatattagaaaaatcgacttataatataataaaaaagagagaagggatttttatgaattgtcacggacacgatacaagggttagaattgtagaaaactacaatatcaaatgtacagcacacattcggttactaaacgaacaaataataagaagtgatgctgaaagagatattaccgacacctattacatctttgagtgcgtaaacaaaaatgatgataatgatgttgatagaattgtttgcggaactggagcagcaagagacttattgcagttggccaatataacagcacctccaatttttaatatgcttcatgaagtcggtggtgaaggtggagcaggtggggcaggcggaggaaatcaacatcaagacgaagaatgggatgctgctgcaaagcaattatacaatgcaataatgatacttattacagcatggaatttaagaccaggacctatatataattatttagaagaagcaagaaggtataggcgttgtgtgccctattcatacagagttgataggataaatcaaatagtacatcgacatggaacatcattaagagatgttttaaatcagctggcacaaaataataatataagaaattatgaatttaatttgctggaagatattcttcataatgatggaattgtatcgtattttgaggatgcaaatggaagagaataaactaaaagccccaatacaggggttttgtagttatagaatggccgtcatcggcgccacgtctacactccgtttcggtcggtgccaaacaggtgccactggcacctaacaccccttcctacgtattccggttgcccggtatcataaaactcggaagactacctctcgctaagcaagcgtcccccggacgcttaacgccctgtcatgggtactttccttagatagtatcctaacatatatatctatatcatgtgcactgcaagaacaattacaaattaaatcttacttactttataggtttatttccagttcaaggcaattccattcttctcccattacagtatacttttctatttcatcttgagatacatcctcaaaacctattgccttatagcaataataagctgattcattattctcaaaaacacctaatgaaactttattagcaccaaatatttctttagcatattttaagcctaatttcagcatattttttccatatccctgcccacgttttttcgaatcaacaattacaaagccaaaccgtaattcctcataaaattcattcggtcttctcatggtaaaaaatcccactatctcattatcatcaatagcagtaaatgccataagattacttaccgtattgaactgctcggcagaaattggatattcacctaaaactcctgctgtccatttataaaaagcattctctccctttatccacgacataattatttctgcatcatttttattgtatggccttaatcttaacatacttgcctcctttttcatttgcctaaaattttgtttatcatattctgtttgccattcgtgtatgcaaccctgtcatctgcatacttactttcaagttcttcctttaatttttcatactgcaatgccacattctcattggcattaagataatccctgaaatgaatataattctttcactcagttccgttccattttacaatatgaatatgatgtgttctgatatccgcctccatatcacccattacatagagcaattgacattctacatctgaacctcgataaaatattcctcttgttacttctgatttatctattctggccatcccttataaatggttccttgatttctttacttaacaaccgactatatgattctaccttacgaaatgtgtttcctaacatttcccgattcctgtattctctaatagcttccatatcaaactccgcataaaaaatcccctcagttttatcatcagccagcaaaactgtgttatcaacacattttccatttctatcccagcaaattggactatatgcgcaggaacatccagcattatctccattcggatttgccatagcgactgcaaccatattttcataagctcttgtcgaaagtgccctgattcttgcttgcatggaaccacaatcatttggtacaagaataacttctgcaccttttaacataagtattcttgcactttccgggtattctctgtcataacaaatcataatacctaattgtattccttcaaaatcacacaccttaaattctttccctgattcaacatctctttcatctgcgaaatcacaggtatgcaccttagagtatttcatcaatatatttcccgacttattgataacaaaggctgagttctgtggttgcttactaccttttgtaaatgcagtaagtactacgcctattttatattttttagcattctcacatatttgggcaattcttatatcattatctgcaatgcttttttcatatgacataggcaaatcatatcctgtaataaaacattctggcaacaatagaatatctgcatgtttttccgaagcctcttccattgccataatgatagtttcaatattcttatctatttgttcattaatagaacgtttttgtagtatagcaaccttgaacattcactttccctcctatagataattcaaaatgtcagataagttattaacttcaatatcggctttttcactctcgtccattacagtccacaaacttccaaatccctgttttatccatatcgttttcattcctaactgttttgcaggtacaatatcattatcaatacggtcaccaatcataactgcattctctggtctgcaacggcttctttccaatgcaatttcaaatattcgcctatctggttttgaaacaccttcttctgctgatgcgataatcaaatcaatatattttcgtactccaagattttctaatctctcagaagttcctaatggttggtttgcgattataccaatttcataatttctgcttaaccctttcaagcaatcttcagaatctgtatacagcttttcatattgtgattcccatttaggtagttctatccccaattgttttgctatctctaaatcaccttttttatttctcctgtataatgatatcgcattttcataaatttgttgcggagttataccagataattcagctatttttttcatcctatcttcataaactctactttcatcaaccagcgtcgaaccaacatcaaaaaacaaccattttatttcatccttcttaggcaaaaatcctctttgtctcgcttcttctagcagtcttggttgaatttccggatatgtccaattaagcggtagttcattcataattgctattttctctatctcactatgtaaatctttttcaaacgtatgtatctccgcgaaaaataactttccaaaggtttctttcccatcaaagttgtctggcgccgtcacagaataaatacatatcggatttatctcaaaattaatggctcctgtttcctcatacaattctctctttgctgtttcaagaatatcctcaccttgttctctatgtcctcccggcacttcccatgtacttctttctctatgcttgcagaatacccattttccattatgttttgcaataataactgcaaactttagctttgaatcatcaatgctatcatagaaattcactttcgtcatataatgctccttattaaatttcttctatttatcatttattgttcccacaaatagagccaaactagagccatttgataaaacaaatgccggaaacccgcataaatacaggctttcggcattttaatccgttattcaaactccccgcagagaaacttattatccctgtgaaagcttgatttctagagcttttaatggcgattattccgccttttatcacaattattttatattttcaaaaatttaggtatcatatgggtatcacattctaattttctgatttatcttttctagattgtctcattgattcatatatcaaactctgtattaagttagtgcagaagtctgtattaataatcgtctcaaacattgtttttaattcttccatagaatcaacatcataaatatactgtttctttccattgtatgcttcagctatatcctcgtttagtacaacttcaactggataagcaatagcaccatatcttaaaaacataattctatacttataatactctaaccccttaactgataaaaatacttcaaatttattgtcaattccactttgttctcccaatacatcttgaatatctacagtttcttcgactttattaaaagcttctgtcgcagcccaaaggttattttttttaacatatgattttgtttgcccttcatacacatcaacattacaaatcaccatatcatttgtgcattctgctattttttttccactttcaataatcacttcttcaggtgacattgtatcctttaattcaaaattaaatgtttttttgttcatagttaatctccttctatcaaatattaaattcacacataataggaaaatgatcacttatattactattagggtacctattatcagtatatagtacaccttttccacattttgttattatttttaattgttccttaaccattaatggaatcatagactgactaataatcacttgatcaagcataaaccagcatggattatataatttagattctactctatagtatgttccaggtgggtatttaaaatctccaaataaattccacataggattatacattttttcatactctttcccataaactgttctcgaacctttatctaaaatttgtaatgctggtaaagcatgaaatccctttgcacttaaacatgccttttcataaggtgattcatttatatctcctataacaataacatgctctgtttgtaatctctgctttatgtgtttaattgaatacataatttcttcagctaatgctactctctcatcataatgttctccattaagatttgaatacatatgcactccacacatgatgtactgtttatttacaatttgaacagaaaaatatttattctgttctccaggcgtaacatcaatataatttccccatatatgtattctctcacatcctttagtgttccaattaaataatctttttttacattgttttaaattatcatttaattcattaatctctgccatatactctgctaatactaatacatcaatttcattttgattaactatatccaaaatatatgaatttatatcaacatttctatgtgtattccaaaacaaaattctcatacatactcaccaatttatctagacatataaaatatcccgtcattttaaattgtattttatccatttttccgtcaaataatttacaaaagctgaacatgacactaacatatacttcgcatcttcacttgccacattaacaaattcaatacttccgtgccttattccacctgaatctgaagtatatccatacaactgcttaaatgcattttccaatgccggatgtatattcactccattctcttttaactttttcaatgtgttccctaatgtcgctgcacctcctgatagtcctgttataatactacacatagactctacactgcttattgattcctttactgaattttcataatctggtttttttctatcagaatataactctaatgcctttgtcatatgtttactaacagattcatattccaagtcaattgtttcacctattgagttcaattcacttttaccaataatcggtacaactaatccatttaaaattctgtatggagcaacttcctcttctagtattcgattgaattctatcgtcaacctttgtgttttttcactatcagtcactctaagatatttttcaataaaatcatatattctataccacataccttcacattgaaccacatgcttatgcaacttttctgcattctgatttttgtatattttatttgctggaaattcatatttaattcccatttccaacatcatatcttctattcccgttgtataagacgtatactccaatgtatcataataatcatactcttctttataaaatacattccatatgcgttctcgcaactgaatacttgtacttctcaatccattaggatttatacttaaaattttatttcttgttgaaaaaaattccataaaacgttaattcacacctctctaacaatgcctaactaatgcacacaaacctgacaagcctctattctttcaaatgaatgttctacctgcaaatctatcatttttaagttactctctatatactccaacaattctgtaccatccaaatatatatacatctgtggtgctacaaatcccggaacattctttctcaagtcatctaatgatatcttagatgtttcctgaaacttagctatttccatcgcatatctgtaatggtaggttttcatatattcttttattctggcaatggcattgctatcttccttatattcttccaaccaatcagataggcaatgccttttatccaaataaacaatacccgtaatcgcttttactggtgaactaacatacatatatgccattatcggttcatctggaaaatttcttctgtgttcgaatatcttcagaccagattttattttttcatacacatctggtctgaagcttaacaacatttttctcaatacttgcaccaccttatttccatacacatttgatagtgcatactgacacaggcatacttataaactgcacatcgaattttaaacttggttctacctttgtacttgcactatgaattctaaaactcaactgccatccattgtccaaaatcatttctacagtattattacttttcggcttaaatccaatgtcaatcagtcttgtcggtaattcaaccacaggaacttcaatttccgaaaccttatccttactcgacttatttaaagtatcatgcatattaaaagtatgaatcaatgtaagtcgtttactgtcatgactaactatcttgtaataatcttcttttcctataaggtattctatcatcttttcaggcatattcttatcttctttatatgccctattaacttcatccataaaagcctgcaataatggtacatatacattttcatctttctgcactatttctgaccatcgtgagccattttctttttcacttttcagcatatcaaatattggattaaccgcaccccaatattcgttactacaaggtatatcaaaccattctttgccaaaatccagtttatgacttaatctgctgtgtttaactgcatcgtgattgtgcttgatacttaatcctatttcccattcaatatcgtctctgcgaataacaatatctcttacatcgcctttaacgccagctccatctttttgaaactctaatgtcagttcgtcattatcgttttctgataatcttggctccatttcaagtacttcattaattgcagcttcagcagaaatcataaatgtctgctgcatttcctcatccataagcatccatgctttttcattcgcatgtaagctggaattatcaactatttttgttttacgcatttcacacaatgccttataaagtgttttaatccacgcatattcatatgctcttccctgatcattactctttgtactcacttttttctcattgacctcctttgcatctataacatcatcatctactaccacatctgcactattaccctctaagtatttctttattgctactgctatttcatatgcaagattaactggaactgcatttccaatcattttataagctgtgtttgtatcttcatatataaatttaaaattatctggaaacccttgaactctggctacttctcttattgtcattcggcgataaagatgttctttgccctctacaaatctgcaatcattctgccccaccttaaccatcttaggtgcctgtggatgtaactgacattgtcttcctgatgcctgtactgtaaaagcttgctcatcccaggatttcactctgtttcggctcataaaaattggagaatatgctcctgtgtaatactcattattattgattgcttctggattatgatgatttttttctcctgaaggcactgctgtatcctgtaaatcccatattatatctctaagagtaatcttcttatcatcttctttggttgaccccttaggaaatccaaaatcaatattcaagtcttttctaaaccctatataaaataccctttttctttcttcagccacaccataatcctttgcattaacaagtgtaaaagatacatcatatcctgctccatcgaaaagattgagtatgttctgtactgcctctgaatgtctattagctaacattccgctaacattttccgccagaaagaatttaggctgaaattccttaagaattcttatataatcaaaaaataactgtccccttgcatccttaatacctttcaatgatccagcttcagaccatgactgacaaggtggtccacctataattccatcaatttcaccatctatatactgttcaatatcttcttttgttacttgtcttatatctccttcaatcagatgtgtattagggtgattagctttgaatgtagcccatattgtcttatcaaattcattagcaacaggaatattaaacccagcgctttcaaatcctaaatctaatcccccacatccactaaacaaactaattatgttcataggtattttctccttcattgttttccttgattattcttgtagcttctattaatgccgttcttctaacaaactcactatatgaagcatatgcctccagtcttgcagcctctttgaatttttccaactcatcttcacttactcttatgctgattgaaattgattttctcattatgtccgttcctccgtttctattatcaatcataaatccgtagtataacaatgtcaatactttgttgcacgaacagatgtttttattttgtttttggggaaagtctttccatcactttcctcacactctccataaacttctccagcagattaaccccatcaatcacaaactgcttcataaaatcataagccttctccaacaactcctttaacgacttattctccttctgaagtctctggttctcatacataacatcaataagtttctcccttacatcgtcatcaccaccatgtcggaacatatcatatacattctcagcaatttttgtacgctctaccagttcattttctttagaagtaagcatttccagcttattctttttatccgtaatcatatccgcatatttaacatactcattctctgctgcatcaatgttatctctgactctctcaagtctatcctcatccgcagctatcatatcaataatcctaacatcaatggatttcctactgctgtgaccttttgatgtaaaacgctttcaatgatatattcttgtctcgtctgatatccacaaagtttcactcttaaatctaattctgcatcttcttccggagacattcgaaatgctatggttacattacgccaccgattcttgctatccctatttttttcactcatccagatattcctctctttcctgatttagattttccgccatttctgtttggattgtcgggaacaaatgtgcatatcgatatgtgatctccacactttcatgtcctaccctttctccaattgccaccgcagaatatcccatattgatcaataacgacacatgagaatgtcgtaaatcatggattcgtatcctcttcactcctgacagcttcacaccacgatccatttcatggtgaagataactttttgaaatttgaaatatcctgtcattttcattcagaccatacagcattcctatatacgattctaattcttcgcttaaaaattccggcatggtgatcatgcgattacgcttcgtagtcttaggatccgtaataatatccttcccctctaatctttgataagatttattgattcggatagtacaagcctgaaaatcgaaatctgccggtgtcagcgctaacaactctcccatacgcactccacaccaatataagatttcaaatgcataaaaggaaattggcttatccgccaccgcttcaataaacttcatatactcttcttttgtccagaaaagcatctcttttgttctttcttttcccatagatccagccttgcgtgcagcattgcttttcaaatcatagaaattaactgcatgattcaaaattgcactcagctgattatggatggtctttagatagacctgcgaatagccttctccttgtttattccgatagttcatcatggtgttctgccactgtcgaatatcggaaggttttatttcctgcaacttctttttcgaaaaatatgggagaatctttttttctacaatatgctttttcgtcagccaggtattatatttgattctggatttgatatcattcagataaagatctacgaaatcttcaaaatacatatccagactcaaattctcctttaacttaaacgctctttcccattcctgggcatcacatttacgtttaaatccccttttcgtcttctgctttcttacgccggtccaatccttataataggttcttacctcgtaagtatttgacttttggtttttgattactgtcaaaacatcacctcctactatttcatttcgttcataccgtaaactcgttcttcaaaatatttacggctgatttttcctttgacaacaacgaaacctttttgctccaattcagcatttaactgacggatcaaacgatacgcataggaatcagatacttctaattctttcgctacttcttttgctgatataaataatttactagccatctatatccctcctttcctttttcagttcattatcgaactgtatatatgcatcataacatttcattttcgtactgtcaatagaataatttcaaaaatgaacggtttatttttgtatttcatttttgaactgtttatgttatacttttaagtaacaatcagcaaaggagtgttttcctatgacagtaggtgagaaaataagaaaattccggattgatcaaggatatacacagaaagaattggcaatcatgtccggattaagcgaatcggcaattagaaattatgaacttgggaatcgttttccatcatcagaacaattagaaaaaatagcaaactcattaaagatcagtccatacgccatgtctgatccaaactttgatacttatgttagtgtcatgcacgcattatttgctttagaggatcaatatggtctgcacgcctaccgggatgaatccggcgtaccacagctcatgtttaaagacaaaggacatgattcttcaaatatgctggacaacattggaacatgggctgatatgtaccagaaattcagaaatgaagagattacagaaaaagaatatttagactggaaagcaaaatatcctcaaaatcaaaatgatatataaggcggtatgtaatatgagcactcaagattcaaataccaaaaaaatagcatatggtgaattacacttttattatccttttaaatttgataataaatattcctatactcagattcacaaaaaaatagaaaaaagtccactattgtttacagatgaatatcagcaaaaggtcatagactctttaggctattctctagttgaaacctttaacgatataaaaaaagaatttgaagcttcaagctcactgaacaatccttgcatattaaaaatgagcgattatcaaaaaaataaatccatgaaatgtgcccccatgtccataaatcccgatgatatattgttagaaatcgaaagtggtgaatcttcaataaagttctatatcaaagatgctgatctagaactactaaatcaaagaatcatacgtttacaagaagaatatgatatttctttaaaattttatggccacaatttcaccaaccggcaagatcgctttcttcttcttcctctcaaaatagaactagaaaacggaaaattcacttggctatacccattaatatatctttttgaaaataatatgggaatattaaaactggaactacctatatttgattcctgcattgaacctttattagaaaatgattatgataggttcctcacaaaaattataaataaatggaacataaaaaattacaactccgaaacgactctatcttccatccagaacttttatttaagtaatcttcttgatgatattaaaatagacatggtttcatattccaatgagctaaaaaatataatattaatagattttgacggaagaccacaacacataaattctattccaaacgatgtgaaggaagatttgtttagaataatttgtgcaccagttccttccagaaacaataccacctatagcaaagatgctgatgaatatctaaagaatcacagttggggaggacatggtgtaaaatatattgctaaatctactggtggttgtctttcttttatagataaaacaatatcagattacgtctctgatgattataagacagaaacaaaaacctctgtacttaccccatttaatgactactataatttatgcaataagctagcacgagatttgtgtgtaaatgttgaatttgctttaataataattctcttaaaaaagaccaatgaatcaaatgactacttcaataaaattgcatctatgaaaaaattatctgatacacgaatcgagtataataaaaatatattgtttatctccgaactccaagaaaattgctatggttcagttagcgaacaaacagcccttttagaaaaaatgatgccgcattatttcaaacacgaaatcacatctgcaaaaaaaatagctatagataacatactacagcaaaatgaacaagaaaaaaatgaacgctttcaaaattacatttcaactggtggtttgattctaacattgatatttggcttaccatcattgtatgaaacattaactatatttagaaagttattttcgttttacccttataacattccttatctcacattagaaaatactagtataatattgtggcttacattaaatggaataattattttaaaactttatttaagaaaatactatccaaaaataaaaaagtattgtcatttgattgtcaccagacatagaaagagccaagaaagcccgtaaaataggcatttcttggctcttatattttattcaaactcaatagttcccggtggcttactggtcaaatcatagaatactctattgactccctttacctcatttataattctgctcatcactgtctgaagtacctcaaacggtatctcggctgcttcggctgtcatgaagtccacggtgcggactgcacggactgcaacggcataatcatatgttctctcatcacccatgacacctactgaacgcatgttggtaagggctgcaaagtactggtttggcatccatgatggttcctcgccgtgggcctctttgtactcttttgctgccttttccacttcgcttctgtaaatccagtctgcatcctggacaatgcgtaccttttcggctgtaacttcgccgatgatacggattccaaggcccgggcctgggaatggctgacggaatacgagatagtcaggtaatccgagctccagtccgaccttgcggacctcgtccttgaagaggtttctgagtggctccacgatgtccttgaaatcgacatgctccgggagacctcctacgttgtggtgtgatttgatgactgcagattctccgccgagtccactctccactacgtccggatagatggttccctgcgcaaggaagtcaacctttccgattttcttagcttcttcctcgaatacacggataaattcctcaccgatgattttacgcttgcgctcaggctctgtgacgcctgcaagcttgctgtagtagcgctcctgtgcgttgacgcggacaaagttgatgtcgaacgaaccgcctttgccgaatacgccctctacctcatcgccctcgttcttacggagaagtccgtggtctacgaatacgcaggtgagctgcttgccgattgccttggcaaggagtgctgcgagcactgatgaatctactccacccgaaagtgcaaggagcactttgccgtcaccgacctgctctctgatttcttcgattgtgtttttgacgaatgaatccatcttccatgtgcctgcacatccacatacgccacggacgaaattgtaaatcatctgtgttccgttcttggtgtgaagtacctccggatggaactgtactgcatataatttcttctcaacattctgtgttgcggctattggacagtctgcagtgtgcgcaactacctcaaagcccggtgcagcctctgcaattctgtcgaaatgactcatccagcatactgattctgatggcagatccttgaacatcacgccgtttgcagaatatgtgatttctgtctttccatactctccaacctcaggtgtgattacctttccgcctaatttatgcatcataagctgtgcaccgtagcagatgccaagcaccggtattcccatctcaaacagctctttctggtatgatggagaattctcttcataacagctgtttggacctcctgtaaggatgatgccctttggattcatttctttgattttctcaatgtctattttatatgagtaaatctcacagtacacgttgcactcgcggacacggcgcgcaacaagctgattgtactgaccaccaaagtctatgactatgaccttttcctgatccatgttttcctcctaattgtttattcgctatgctgctgttttacaatctttgaaatgtcacgtaattgctgtttgccacactgtggtgtaaacaataacaaaacataacatatgttatctgctgccatctcattgattacgtaaaagcaacatgttttcttatgtcattatagattacggagtgcttatctgcaagcgattttgttaaatttctgttttgattttatgtgcaattacgttataatgagttataaacacttttataggctgggaggtttcatcatgagttttaaaataatcactataagccgagagtttggcagtggcggtcgctttatcggcgagcagattgctcaaaaatgcggcattgagttttacgataaaaaaataattgagcatgtggcaaaggagctcggtatctctgagcagattgtcgcaaaccagggcgaatatgcacctgccggaagtattttttcatatgcatttgtggggcgcgacatcacaggagtttctctttccgaccagattttcaatattcagcagaagctcatcaaggatattgcgcaaaaagagccatgcgttattgtgggacgttgcgcagactacattctttctgacagggatgatgtgctgaatgtttttatagagggaaataagcctgagaaagctgcaagaataaaaaagctctaccaaaagagcgatgacgaggtcaaaaagctgctaaaggatgtcgataagaagcgctctgtaaattaccgctactttaccgacaaggagtggggcaacagaaaaaattatgacctagtgctaaacagctctgtgcttggatacgataaatgtattgagctcataactgctgcatacgcttaacatacttaatacacttaatatatttaatgagcttaatatgatcaggcagcgcaacttttgcaccaatgcaatacggaaaattgatattattattactattaaaaaaccgttttcttattttttttattacgaaaaacgtaaatagaattacaacctgtgtgtaatattaaaaatactcctgcataaactgtaacaacagaatatgcaggagtattttttgaaatcatatattgagacaagggcggtggaaatcgccaactacatagttgaaaacaatgccacggttcgccaggccgcaaagcagtttggcatcagcaaatccactgtgcacaaggatatcacggatgctgacaggctgcttcgcatagacccggagcttgccgcaaaagcgcgtcacattctcgatatcaacaagtccgagcgccatatccgcggcggacttgccaccagagagaagtatctgcatctgcctcatgtgcatgccggctgagtgcatggatgcttctatccctgcattgccaggtgcgcagcttttcgcgcatctgaggcttttcgttaattcaagacaggtgtcacatgacttgtgagcacaccgtacagccacttgccctcatcgcttagatcctcataggtgaagccgcttgtcttatcgcaggcagtggttagaagcgctgatttttcgtccttattggacagattccagcacacatagctgatgccgtagctgtcgagcaggctgatccagttgtttgcggaatctatgtccacctgaccgtttccgtcgtcgctgcagatgccaaactctgatacaaatatcggcagtccggcgtctgccgccgattttagcttgttttgcaagtcctccttatgggttgcggcatagaaatgcagtgtatacatgatattatcatagcctgtgacagggtccttgactgcctcatccacatcctggctccagttaggtgtgcctatcagtatgactgcatccttgtcatagcttctgattgacggaatgacctcgctggcgtaaaacttcacatctccccaggtcgcacctttgcacggctcattgcaaatctcgtaaatcacgttgttgtatgaggcatactgctgtgccattttggcaaaaaatgtctttgccacatcactgtagcggtttggattgccctcgtttagcacatgccagtcgatgatgacatacatgtcgttgttgaacgcgtactgcactccgttttgcacaagtgtctcaagctgctgcctgtcaccatctgtgcagtagccaccgctttcgtaagtgtacatggcgagcctcaccacgtttgctccaaagcttttcagcgtggcaaagcaatcattggtcacatactgtggataccacgcaagaccgtgtgtgctgactccgcgaagctgcacctcgttgttattttgatcaacgagcttgctgccctccacatgcagcttaccgtttactgacggacaggcaagaactgagctctcctgtccgttttctgtggtgagctgctctgtgtcagccacattctgattttctgtactgctttgcgtactgtcctcagtattattttctgcagaattcaccgactcagtggctttctcatccgtctgtgactctgtctctttgttgcccttgttaccacatcctgtaaaaatcccaagcaccagcactgcagccaataccaatgctatatatttcttcatattgttatactgtctgactgattactgaattgatgtaaccttgtagtcctcagcctctacagtctcctttaatttctcatcggaaatgtcagagcttaatgtcactactgcagttccgctctcatggcttactgctgcctcactaactgcatcaagcgcctcgagtgccttctttactcttgcctcgcagtggccgcacatcattccttcgatattcattgtctttgtcattgatttttcctcactttcatttggtttatttattttgttttttctatctgttgttgcttttctgtcatgcttaggatcatacaccctgcacagattcagccgcagggcattggtaacaacgcagaagctcgacaggctcatcgccgccgctccaaacatcggattgagcttccatcctaataaaggataccacaaaccggccgcaagtggaatacctattacattatagaaaaatgcccaaaacagattttcgtgtatatttgtcaatgtagcacggcttaaccgcactgctgccggtacatctatcaggcggctcttcatcaggacaacatccgctgcatctattgccacatcacttcccgcgccgattgcaattcccatatccgcacgtgtgagcgccggtgcatcattgattccgtcaccaaccatggctaccctgccctgtttttttagcttccttatgacagcctccttaccatccggaagcacacctgcgatgacttcgtccactcccgcctgctttccaatggcattggcagtctgctcgttgtcaccggtgagcataacaactctgatacccatatttttaagctgtctgacagcttccggactatcctcctttattgtatctgcaacagctatgataccgcaaagcctgtcatccgcggcaaagaacagaggagtttttccttcctttgaaaattcgacagctttcgcgcgcatatcatctgacacttttacaaatttgctgacaaaagcaagatttcctgcttttatcattttgcctgcaagtattgcagtcagaccatttcctacaacagcgctaaaatccgtcacctctgcgacagcgatttcatccgttttagcgcgctccataatggcttttgcaagcggatgctcgctcttggcctcgactgatgcggctattgcaagaagctttccggcattattgccggtttcctcaaaaaatgtctcatccggcacgatatccgtcaccttcggctcaccgcttgttatggtgcctgtcttatcaagagccacaatctgtgtacgtcctgttgcctcaaggcttgccgctgtcttgaagagtataccgctctttgcgcccttgccatttcctaccattatcgcaacaggagttgccagtccaagtgcacacggacagcttatcacgagcaccgaaatgcctctggcaagcgcaaagcccacggtctcaccggctataagccatgctattattgtaatgattgcaattgtaataaccgccggcacaaatactcccgataccctgtcagcgatttttgcaataggtgcctttgtcgctgcggcatcagaaaccatctgtataatctgtgagagtgtggtgtcttcgcctactctggttgcgcggcattttataaagcctgactggttcactgttgcagcgcttactgcatctttcggctgcttatccacagggatgctctctcctgtgagtgccgattcgttgacagcggttgttccatctattatttcaccgtccacggggatattttcccccggtctgaccacgaaaatatcgccctttttcactgcatccacagaaatttcctgctccacgccatcccttacaacggttgctgtctttggggcaagctgcatcaggctttttaaagcgtctgttgttttgccctttgagtgcgcttcaagcatttttccgacagtaatcagtgccaaaatcatggctgcggattcaaaataaaactcatgcatatatgacatgaccgcatccatatcgccattcacctgcgcagctgtcatggcaaaaagtgcatacacgctgtatccaaacgatgccgcagagccaagcgcaacaagcgtatccatgttgggagcgccgtgaatcaagcccttaaagccactgataaaaaacttctggtttatgaccattaccgccactgtaagcagaagctgcaaaagccccatagccacatggtttccattgaaaaactcaggcagcggccagccccacatcatatgtcccatggaaaaatacatgagaacaactaggaatatgagcgatgctataagcctattgcgcagcttcggtgtctccctgtctacaagcgcatcctgcgctgcctttagctgctctaagctgttattcgctttgtcattttctgattctgttgctgtgcctttgggactcgctccatagcccgcctgctctactgcctccactatctgcgcatctgtcgcgcttccctcgactcccatcgagttggtcaaaaggctgacagagcagctcgtcacaccatcaaccttagagaccgccttttccactctggcagagcatgccgcacagctcattcctgtaactgtatattgcttcatactgtctgtatttccttctttctactattcaaatctaactattcagaagccttttctaaaatctctcaattcctgtcaccttgaaatccagtctttcgatggcaaatgtgatttcatcatcgcttagcgctctggttgcctcaacatgtgccacgccatgctttaaatccacatctgccgatactccgctcatcttctgaagcgagcgtgtgactgagttcttgcagttcatgcagtgcattccgtctatgtgcacatctgctcttgtgactatctcgcctgtaagctgtactgtggcttcctcgtcctccttcatggctccaccgccacagcaggcgccctcgccctttgaatgcttaatagtctcctttaagcccacaatcgccagtgcggcaattattgctattattaatattgtgattattgtactcatttttatacccgccttcttataatactacttcataagcttctgcagtgtgttcaaaagctcatctattgtctcatccttgccggctcttatgtcatctgccacacacgtctttatatgattggccaaaaggactttattgaagctgttgagcgcagcatttgcggccgccacctgtgtgatgatgtcagggcagtagcaatcctcatccagcatacgcttgattccacggatctgcccctctatacggctaagtctgttgatgagatccttatattccttctctgaccgctcttttttgcggttgcagcaacagcatttggtttctttttctgccatgggtgcctccatttgttctttgttccgcattatgcatttgttttacttgtctaaccataccccttatgggtatctgtcttcaagagcattatataccccggtagggtatattgcaagcaaagatttccttattgagaaattttcaaattatcttctgctcctccctcatgttctacaataacccggtctgtgatattctccttattttctccatcaagaatataatactccccactatacggcactttatagctcaccttaacatctctgcttatagctcccagtttttcagcttcttttgcctccgcaggcaaaatatatacatcctcataaccggtatatgagtatatgcttaccgtttcatctttttccaaataaacagtcggaccgctatattttctatacaccagatcacgtaccgaatcattattaacatcaattaatgcctgaatatgttcaatcatatcggctgcaaatgacctcaccggcgtgatacacatacacaagacaactacagtcacaaccgctatcgcagcaaaatatgcaggatatcgttttgagctgtgagtggtatgtaattcctcgatacattcttttcttacctgctcaatatcaggcatttcatgctgcgctgcctgtctgaaaatatcattttttttcattctgcatcaatcctccttatccagattttgcctaagctcccttagggtacgatataatctgttttttatggttgattcctttacagaaaaaaggagtgctatttctgaaatatttttatccatataataatataaataaaatatttttttagtaagttcatccttcgcagaaagatatgtaaacacactttgtactgtttcttttgatattgctatatcatcaaacgaagtctgttgtacagctatatcattttcatctgccgacaaaatattataatagttcattttctcaatgccacgcagcttttcttttaatttataatgacgaaaaatttttctctttgctatttgcattacaagtgcatccggctgcttaaaatatgatattccatgtttttgtattattttaacaacctctgtataggtttcctgaaatatatctgctacatcttcagtttttccacattttacaatgatatacgctaaaaccttctgattggttgagacatatagctcattaaaaaagtcatcctgtgcctgattaatcaatctgcatccctcccttcactatatatgtgtcccaaaccatagaaaaagtttcatgttataccatacttttataataaaaacatgcaagctgtgtcctgtccctcagctgcagcttttcaagtatgacactgatatagtttcgtacggttccctcactcagatacagctcatccgctatttccttgttgtttagtccttctgcaaccagctctatgattgaaagctccttgccgcttatatcatagctcttcattgcgtcaatgaaccgggcctgaccgatgcctgatgaagctttaccatcagctccgaacaggtgtggtatcctgtccattatctgtgttccaaacactgtctgtccgttgtttacagctctaagtgccggggcaatactctcaaaggcctgttttagtatatagcccttcgcccccagcgagattgcttttacaatgtattcatcatccgaaaatgtggtcagaagaagtattttggcatcgggatatttcccgagtattttttctgctgcttcaagacctgtcatgccctgcatccttatatccatgagcatcacatcgggcatatgctcctcgtacagctttaccgcctgctgcccgctgtctccaaccgcagacacctctatgtcatcctgtgcgctcagtattgtattcagcgaaagtgatacgagattatcatcatctattattactattttcatgtcctgttcctttcttcttcatgagcgtcacaaatatcatgaaaccatcgtctgcctttatccgcatggttcctcctatcgctgcaacacgctcctttatattttttatgcctattccatctcctgtttctcccgaaattcttctttcgtcagccgatgtgccgttgtccattatctcaagctggtaaaaggcgggatgctctctgactattatcctgatttcatcgccgttactgtgcttaactgcgttgtttaccgcttcctttgcaattgcaataaaagcatacttgacatctctgggcacatcatcctcacagtcgtattcgagtgaaaatgcaaatgcactgtctgtaggcttaagcttcgcaagcgcctgacgcaaatcgaccgattcatcgtacaaatcatgaacactttttctcatgctgtccattgccgtatcgagtgtactctttaggtctgcgataggcgctttaagcttttcatcagtatttatcacaccgattgctcccacctgcaaaatagagcgcgtaatcatgtgacccacgttgtcgtgtatctcccttgcgatacggtttctctcctttagcgtggcattgtatatctgcgcattctgcttctcgataagctggtgattcatctgctccataagcatgtcgtgctccatggacgcatctctcatgctgtgcatcttcatctgatcccccaaaagcagctctgtgaaatacgaaagcattaccgcaaaagccatgagaagtacaacctccaggatataaaaaatcccgggtgctatatgttttatctttaaaatacagtccaccgatacaactatccccactaaggctgcagccatcctcgatgccgtgtattttctctttctgaataccatcgctgcatacggcagcataaaaaatgatggtgcaaaaaatactccggacagaatataaaccgccagaatcaaatcaaaagcccggtctgccgttttgctctccttagcaggactcatctgcggcacaccctgcatgtctataaatgtgcacacaattattcctgtaagtatgcacgctatcatgacgtaatcgacctgaagggataccaccataagcatcacgcatgatagaactattaaaaactgactacatatcttatacattaaaagcctccatttccgtaaaataagcttacaacaaattccatcaaacgtcactatgacaaatgtcattttttacacaaccaaaaatgaatttctaaattccaccgcccaatagggtgatggaatttactctcgcacagtagatatttactctttcatacaatcatgttatggttatgactccttctgacagcagtagaaggagaatcattatgagtaaatatataccaggaaaccagaaacaccttactttaaatgatcgtatctatattgaaaatgaactggcaaaagggactccctttaaagacattgcagcatttctatgtaaagatccaacaactatatctaaagaagtccgtgctcatcggctttcagattggtatcacaaaggtactttttataacgcaaagaacttttgcattcatcgttaccattgtcaaaagaccaatgcctgtggaaaaatccttctctgtggcattaaatgtgcctcatgtcctacatgtaatcaaacctgcaaggactttgaaaaagaacgatgtaaacgattggacaaagcgccatatgtttgcaatggctgcacgaaaaagataaatcactgcacgattgcacataaatactattacaacggccgtgctgctgacagaaaatatcgtgaactgctgatatcttctcgttctggaataaatatgaccaagcaccagctccatcagaaagaccagatcatatctccattaattgagcaggggcaatccccttatcaaatccttacaaatcacccggaactggatatgtctgtccgttctatgtacacatacattgacaaaggactcttcacagcaagaaatattgatttgaaaagacaggcaaaattcaaaccacgaaagtgtcataaaacacaaatcactgatcgttctgtttttacacacagaacctactctgacttttgttcattagacctgtcgtcttttgtggaaatggatacagtccattcctcaagagaatcaaacaagactctcctgacactgttttttacgaaagaaaagctatttcttgcctttttacttaaccgatgtaccaaaggtgctgtaagacttacctttgaccgtttagagaagcgcctgggcacatatgaatttatatccgtttttgaaaatatattgactgatagaggttccgaattcggagatccggtaagccttgagacaggcattcatggaatccagagaagcagcatctactattgtgatccaatgcgcagcggacaaaaaggcgctatagaacaagcacacacaatgcttcgtatggttttaccgaaaggaacttcttttgaattcttaacacaatgggatgtgaatctcatcgtaaaccacatcaactccactccgcgagaaatcctcagtggaaggacaccatatgaagttgcattagaaacgcttggtgaagatatcttaaaagcatttcagcttaagccgattgaaccggataaggttaatctgacgcctaagctgatacgctttaaccattaataaaactaatcgaaatctgctgtcagactggatgtaaatttttcacatttttaagatgcggctggtggaatttagtctagcacaccgaattccagtagcctatttagcatgtctagaaatcgagaaaatttcgataagtaacattaattatagcagaaaacgagagatttagtccaaaaatttcttgttaaaccagcaaaatttaaatcacgatggaatttactcttgcactggaatttactttttcaagtcagcattttttacacaacaatgcctcatccaaacataaatacgaatgtgacatttgacacttactttccggcacgccatatagtaatctgttattgagccggatatcaggcttgcaaacgaaaatacaacattatggaggcaattcaatggatacaaccaaaaatgcgatagaagtaacaaaccttgtaaaacgctacaaggagcttgtggcactcgaccatttcaatctgaccgttaaaaccggcgagattttcggattgctcggaccaaacggctccggaaagaccaccactataaactgcatactttccctgctcacatacgataagggagatataaaggtattcgggcaggaaatgtactcaaacagctacgatatcaaacgcgaaatcggcgtagtcatgcagaatgtggccgtgtacgacgagctgactgtatatgaaaatatcgactatttctgcggtctttacgtaagtgacaaaaagctccgcgaaaaatatgtaaaggaagcaatggatttcgtggacatagcggattacagcaaatttctgccaaagaagctctcaggcggacttttgagacgactcaacatcgcgtgtggcatagcacacaaaccaaagctcatcttcttcgatgaaccgaccgtggctgtcgaccctcaaagcagaaacaagattctggagggcatcaaaaaactaaaccgtgatggtgcgacaatcatctacacctcacactacatggaggaggttgaacagctctgcgaccgcatactcatcatggacaagggcaaggctctcgcactcggcacaaaggacgagctaaagcgcatgatcaaaaatacagagaccataaacgtagaaatcgcagacctgtcagaagcacagcttgacgcattaaagcagctgcacaatgcatatcaggtcagctttgaaaacggacagcttcggatttatttcagtggcggacgccacaatataatccatgtgcttgattatctagagcagaataatctgtccttcggtcaggtgtacacgcagcttccgactcttaacgacgtattcttagagattaccggaaaggagcttaggaattgatgaatggactaaaattattttttcacaacgcaaaatacaccatgctaagcatgttccgcctgaaagtcacgctgttttggacacttgcatttccactgttgctcgccacctttatgtatatggcattcggaaatctgtttgaaaaggatgaaatgttcaagacaataaatgtggcagtggttgaatctaaaaacgatgacactctgatgagcgtgcttgagtctctcgatgtaaaccatactgattccgtcagtaaatcagacgacaagtccgatagcacaaattcattttcagacctcataaacatgaagctaatggatagctcagcagccaaaaaagcactaaataacaaaaaagtgacaggcattatttacacagaggatgcttctttagtcgtggaggaaaactcatacaatgccacaatccttgaatccatcctgacacagtacaaacagcaaaaggacgtatttacaaacatagcaaagactaatccggctgcgcttgagactgcaattgccgggctttctgaaaccgcatcagagtataaagagatttcactttcatcgggaaatcaggatgaatacaccaattacttttacgctgtttttgcgatgagctgcctgttcgcctcattttcagccgtaagctccacctgcaggctgttagctgatacaagtcctctcggcatgcgaaaaagccttgcagctctaagcaaaaacatactgattttttcagagtatatttcactcttaatcatccattttgttgtcgagctaattgcattagtctacctgacactactcggtgtggacttcggaaacaaatatccggcaatcatcctgacactgtttttcggctgcatgataggtctttcaatcggagtgataataggtgccattcctaagcttacagagggcagcaaaatcggtatctctgtcggaatcggcatggtgctttccgtgcttgcggatttatgcgccaacgggataaaagatatgattgagcacaagcttccgattgctaaccgcctcaaccctgcctgtctcatatccgactgcttttactcgctcaacgtatatgacagctacgacagatttttcagaaatatatcaataatggcagttgaatcagtgattcttttaatcattgcctttgcactgcttcggagggaaaaatatgcaagtatttaaatcatatttcaaaatactcaacagacatatgggccagatgattatgtacctgtccatattcataggtatcatggtcgttctcactgcgacacgcacaaacaaggctgaaggtgattatgcggctgccaagcccaaatttgcggtatttgactacgacaaatcatcagaaagcaaagctctgacagaatatcttaaaaagacatgcatcaaaaaaaatatcaaaaacgacaaaaaggaaactatgcaggatgagctttttgccagaaatgtaaactgtattctcatcataaaagaaggctttagtctcgatgtcgtaaccatacccggcacacaggcagcgaccacctttgagtctgccataaacagctttacgaaaacgtacaatacctacatttcttccggctactctgaagctgatgctctagccgcagtaaacacctcgctaagtcaaaaggcttctgtctcgctgctcagcggcaaaagtgtcacctcgcactcagggatattctactgcttcagttatctgggatgggtgctccttgtcatgatgattgcaggtatagctcctgtccttcaggttttctccaaaaaagaaatcaaggagagaacatcctgctcatcctataaatttgcaaactacaaccgcgagctgcttttgggtgtgattttaaccggacttgcagtgtgcgctgtaatttttgtctcagctacaatcatgtttaaaggcagcacattctcgttttcaggtttcctgttcacactcaacatgctctgctacatgctcgtttcactggcatttgcctttttcataagtaaaatcacctcaaacagtgagatactgaacatgtttgcaaacacagtgtcactcggcatggcattcctgtgcggtatatttgtgccggaggaatttctaagtgatggcatcataaaagccgctcacttcctgcctgcctactggtacaaccaggctgtaaaaaatattgactttcatccggtcagggagcttggctttatttcaatatgcatgggaatacagcttctgtttgctgccgcaataattgtcgttgcccttcgcatcacaaaagcgcctgacggcttcaaaaagcatacagcagctgtagctgctcataaatagctctgcctcatataaatatatacaacgaaaaagccggtacatcatgcttccatgaatgtaccggctttaaatacttagcagtccgtacgggaatcgaacccgtgtttccgccgtgagagggcggcgtcttaaccgcttgaccaacgaaccgtgtattataatatcatggtcaaacgaataatgcaagtatttttttaatttttttcaaaaaaattttccgttcatttaccttaaacattttccctttaaatgcttctggctttaattccattttcgtccctatgtatgctctgcgacaatctatcatattccggctccttatcccaaagcacacgttcttatcctcatattttatttatacgttttcctcttgagtaagattatacactactttggtcacacaacggtcacacggagcacttttccacggattttgtaaaaagtatacattgaaaatgccgaaaactgtacaattttagacaattttcggcatttgcgtattttttattcgttataatcaactattatttattatattttttgtatatcttttcaaacgcaggcatggagcgctttatcatttccctgtcatcctcctttgccttctcgcagaatgcattgctgtcatcctcgagagcctttacaaacatataaaaggaaaatccactgcgcctcgcggctgtcagcaaaaaactttatgaattcaaccataatgattttcagtgtcccggttagcagcttagctagtccaagaaatcgtccgcatgcccctttgatgtttttacattggccttcacaacctgcttaattgccttttttcgtttgccttgattaatttcataagattgcataaatcaaccttctccttccatacctttcctccaagaatttatttaatgtttaaatatctaaacctgtttgcatttttatctatcatccttattttcataaaaggctttttcacacctttcttataaatcaccccacattcactattgggactgccttcgagagtgattttgtctatttctgaaaaagcgattactttttcttttccaaacagccatttatatctgatttttctgttttctatagtatatttgtatgtgcatgtatgtatagctgatatgacagaaaaaactaggcatactacccaaaacagatataaatctggtctgttatctgcaactacaattgtcatgattaggaatcctaaaaacaccaatactgttactatggatccccctttatagaagtttggtcgataaatcacaaatcgttctgtattatttatatcttcgggtggtgttaagttatagagtttcatcatatccttttcaaaccaatctttgaatttaatagaatgtttacttaataacgtaagtcctattccgtacgccgcaaaaatggatagcacaataatcattattacaaatccagtgaatgctctgggctcattaatattggatggtacaaagaaagcaattaatagcaaaattgcaatcaagcttaaagtacatccataaataatacgccccatgaaagttcctatttctgtttctttctttttcttcttttttgtatcttctttatataatttattactcatcttataccccttttaaaacaagctcattatgcatacaattcctattaccaggaaaattgagccaaatccataaccgaacaattttgctttcttttccacagaaccattggggaactctttatcatcaatgtggatataaatagttttctggaaatttagattatcagctattttggttactatggtttctttttgggaatcatcgtatttaaagcagacttttcacccaaaaatcatttataaagaatacctgtataattgttcaacacatcatatggttgtattacattcgataccatcgaaatctccagtttgtagatagtatttaaatcgccaactgctccttcaaccggagtatatctgtcaatataaacatttgtcttcttttttgtcgtaataatcaatgccacatagtcatccgtagtaaccagtttataataaacatcttcatctggaaaactctcacgtgctctgctcactatattagcaaaattataacgctcggattcctctcctaatggttcttctccaccatcaattgcagtctgaagttcttcaagtaccttcactgttctgtcgtcattttttctgttgtcagcaattgactgaatagtggttcccagacagattactagaatgatagcagccataatagctaatgctgaaacaactccgattacgatttctcgtttctttttcttcttttccatctccgttaactgtgtagctgcaaactgccgcgaaaaagtatcagcatgctcatttccataggcaataaatgcctcttctgtattatatcctggatacatctggtagatctggttttctgaacaaaacttctccattcgccaataaaatggaatataccatgaggtatattttctacgtcgaacaaaaaatataagcagccctattacaattatagaaaaatatcctgtcataagaattgcgtcttccaatccttgtatacgagaggcttctttctccggtataactgcgatgatactgtaatctccactatcttcatccttagaccagtaagtgttaagacgtcctccgtaagaccatccagtgggatctaccccaagatcagtcaatgaatagacaacgtgctttcctttattcggatccttaacagataatgtaagtccatcctcctgaactacacctgtcacagtcatagttccttttaattgctggcctgttgcagctttaatcgcatcaaatccaagaccaaacccaaaaaaccatacacatgtaaggacaaaattaagaacaataaaacgaatcaagcttgcccaaagattgtatctcaaagatttttctaactgttccttttctgaagaagggatgcctggcatggtaatataccaggaagcaatcatttctcgtcttgtttcattttcatttgcgcgtttgatattagcagcatctcgtacagttgttgccacccccataagcacactcgtttcacatatttttcctcagtatctctattttatggcaatactaactttatctaaccaattctcggttaaatcagttaaatcccctaaacatttcctcatctatataacagccagccttgtcatactccgtgagatttatggcacagtcaaacgagcctatcatgccttctatcggctgtataaatccattccaaccctcgcccttcatgccctgtcgcagcctcttccaatctgtaaacatacgcaccgcaggacgaccatgtttaccctcaatcgtagccagtgcaatggtcgtatccttctcaattaccaccttgccattttcgtcgggacttggcatatcgttgtctgccttcattggaattaaaaactttgctttcacaagctctctcgacatgaaagaaaaatatagcttatagatcagctccttatccggtgtatctgggtgtccaagctccgctatcagtaaaatccatctctccagatccggattcataaccggtctgtttatctctggaagattgctaaaatccggcttttcgactatcttctctgccgatatcgaggtattactattgaccacacgcactccgcaggctccattcatataaaaaatgcttccaaaaaagtcgcttatcgcattgctctgattgttttttatctctcttatttcgtatttttcagctgggaatgttgctcctatcacatccttatagggttttgtgagtatccatatatccggtggtgtacacatataagtaccatctttctgatcaaccgtttctgaaaacatggccggttcaccggttattttgctgtatacacaatatatctgtgatacagagagcattttggtcacaattgcctctgcaagctttgctatcttctgcatatctttcgctctatctgcatcagtagctgtcggcagtaccttgcatctataccagctatacagtcgccacatttctgcaccgtccgtgatgctcatacggtcaagctcgtcctgtgtcagctcgatctgtctgtgaaagaccatctgattacccaacgccttcacatatgcatcatgaacatcggatacgcttgcctgtctcgaataaagcacagtaccacatcgaaacggaaaatctgccgcgcactccagctttaatcccacatgacaatccttggcctcatctgcccttttcccgggttcaagctctattccaagcactgtcgtcagtaatacttccccctcctcgtcatccgagaagttggttacgtagactgctgcccccactctcacagttcccttcacatagcccacgaccacaatatcctttgtgttcaagagagcaaacctgtcctcaactccaagcacaaagctttccggctcatcattctccttctttttaaacgcatcaaaaattcccataacttgatttcctcctgtattctcttatatgtatgtaatcctgttgtcaaatagagaccgccactatgagctggtcgacatccactccataaaaaatcttttcacgtcactgtaattttagctttaatatctggtatttctaactgattcatttatcatcctcgttatgaagttttgttctttcgtatacctaggggcaaatttcgctttaacctatgaattcctctacggaattctgactcaatttatagtaatcggtcaccgaaaagttttgccttcggcaatggttatggaggtagttggatttattagattttacttctaagaaagtcctaaagtataaccataattaagtataatatatgttaatactactaatattgcttctaacgtcatattctgatacaatctttccccattgatatttttcaccttgaagtaatcccatttctgttaaaattttatcatgtatcttttttctgtctctctcgtttgattcagaaaatttttcatcacaacaaattaaagacaccatataaattattccatctcgaaagaataaactcataataaattgcctgccataaatcgtttgatgctcgtctaaataaattattctaactccatcttgtccattataaaattttgttgttttaaatttatcaaatgaataattgggcccgataactaatccttctcgcgtacttacttcaccattcgtaacatctatcatatctaaaattcctactttcttaatgtaatattatcaaccttaactaaaatgcctttttgtatataatcatttgcatttggtacaaaatattgtggcaaccctccttttccaaattgcggatttgcattagttattccatatgcactcgctatttcctcattaaagacatatccttgcatctcccccctatacccatgtataggatgcttttcaacctgcaatccttcaaaaacattagttgcatctcctccagattgctcaatggcatccaatgttgtaaaatactctgttccatttggttctcctctgtacagtattgtcccttttttaacaacagtatctacataatcatcaactcctatgtattttccagttccttgccaacttcgtgccaactgagatggcgttgcattttcccatactactttgtctgagccataagtttccctaaaatatctacaccattcttctcctgaataagaagatgtacttccaccctctacagccgaacccacatccgcatcatttaatactgcgccaccgtcagttcccacatctccaagcttcggtttcgccagtttcttcgctcctgcttcaattccattcagtcctttcgcagttgccatacttgctgccatacctgctatcattcctgcggtctggtttccggttaaatccgtcgtatacttctgggctcctgcacctgcagttgcaataatacatgccaccccaacaccaaccaatacgactccggcaacggtcttccacactccctgcgtctcacgttcttccgctgcatcctttaggttctgttccgcttcacagattgcatcatatacatctttattgtcttcatgctgctgataaaacaattcactgatattggcaagtgcatacacgtccttatctgtataaaagctgttgctttcataatttgcaattgttccctggttcaaccctacttttgcaatacagctgttcaggctcgaaattaataagtctacagaattctccagcgctgttacggtactactttcctgattttggattgttgtaataaaattcaatagctcctgatccaactgctcatgtaaaccaattattttataacttgtttttcctcatcaagctttactatatttgaatttaaccatccctcatatgcatatttgtcaactcgatccaacttcagcttttcccctatcttacagtcatttgtactaaccaaatattctccgtttttttcctttataattgaaaccctctcttcattcacctttccataagttgcaattttgtaaatttcatctacatctgatatattcactaatttactgtatactcctgtattatatttatctttaaatgtacaatcagttttctttagatctgatgttataataatataattaccatcagcatctcttgaaaatttatattcatttcctttataataagcatattttccattttttatcattttttcacctctctgaaatgttcgccatcaaaaatagctacgatagaatcttctgaatcaattaccctatgcaattcagcaccttctattggttccaggttaccatcaactgtccattctggaataacttctccattccttgcacctgtaaatccattacgtgtacatggggcagggtctgtatttcccccaccaaattctgttccatacggtattccaatcctatccacatcatccgtcataaatttaatataaccatatgcatttccaccttctggatatggtctaatatcactatttattgtatagtctaatcttgatgattctacaacattatcataaccatgaatatgtgaaacatcatcatatcttgctatatagcctctgatagtactatatccgtcatctcctatgtattttcctatatcctcaaagggaatagttttttgaatcactgtattactatcaatcttaggcactgcttctcttatattttttaattttccaatttgttctgctgacaattcatttacatctgctaaacgaagtgtattaaactcatctaatgtcaaactttcattagctaacacagattttaaattatttcttgcaaacgctgaacctccgccgtctccaacatctccaagcttcggtttcgccagtttcttcgctcctgcttcaattccattcagtcctttcgcagttgccatacttgctgccatacctgctaacattcctgcggtctggtttccagttaaatccgtcgtatacttctgggctcctgcacctgctgctgttgcaattccttcttttgcaacgattgttgctccacttcgaaatgtcaggtttcctgctgaggccgcctgaccgattggaatcattgcggatgctgcaaatgcaaagacactttctgtcagataatatgcttcctcatttccttggaataccacatattttaagtcatttactgcggtactgtcaatatctccgatgcttccataataaatatcctgggcaccttccgcagaatctgcgactccaaaaatagtcgttccggttccaacaataccctctgcggctgcaacaattggtgttgctgttccccatgatgcgactatacatactccgcctactacaagcaaacccactccggcaacggtcttccacactccctgcgtctcacgttcttccgctgcatcctttaggttctgttccgcttcacagattgcatcatatacatctttattgtcttcatgctgctgataaaacaattcactgatattggcaagtgcatacacgtccttatctgtataaaagctgttgctttcataacttgcaattgcagctgtgttcaatccgatttttgcaatacaggtattcagactcgatagtaacaattccacggaattctccagtgctgtcacggtactgctctcatggctctgaacttctgtgataagatttaataattcctgatccaactgctcatgtagttctaatacaccattcgtacttggtgtaccgacacccgatatatccgaaatgccagaaactgctccctgtatttttccggtataagactccgtatccgaataattggtgcttagttttgtccggaatgcacggattgcctcctcgctaagtttaaaatttgtagaattgtcaatatcataatacccggctttgtataatgtcatgttgtcaagcaggttctgcgctgtgactcttatacttgaaagcattgtgatatgtacatctgtcagataactttttactgcatctcctgtttctccggtaaacactgcattttttataaaaaaattaatgcagttctcacaagtatcaattttattcatcagattttctaaatttgtcttgtactcccagaacaaatcatagatatctgtataattaatttgaaacccttccattttcctctcctgtcattcttatggtgtcaaacatgtgtcaaatattccggtgccctgcttaaaaagctcactttgattcttatctttttgcacttgtgaatcaactaataaatcaattgccattaagtccatctgcaaagtagtactatattggcttaccgcactctttaacgtttcataatcttcctggagctttttcattgcatccgactgccctttgatttccgttgcggaagccggtaagcttacagaccgcgaagctgttcttatcgcattggtattcgaatatacacttacgtaatctaaaatcgttcccacttgtctatctcctttcctttttcattcccatcaactaattaaagaaattacggattcttgtacataaatcatcccatgcattgaccaggccagataagataccatatttttcattctttctctcgtttaatgcgtttatttcccagttgattgcatcctctgcatcatcgatattcgaaacatatccatcataacttgtgtaaagatccccactctcacataaatcatagaaatactgtgccctgctgccagtccataaactttgataaagatctgaacttatcatattcttctgatttttgttgatatcatcaatggcttctttcgcatcatctaacgtattatatgcatcccgcaatctgtcaattttcgcatcaatctcattgatttccaattgacatacttcctgctgatgttcattacttgccttctgattctttaaattttgatatttgtttctgtcatactttttagccatcttagttccccatattctgcttcaactgtctgacatccgcacgctcaatctccaacatctccattgccttctggatattggcacacatcattttctcatcatcatctgaaaatccctcaaaaaccaccttactaacatcggaatgctggaaatacattagtctatcccccaccattccctctgggtatgcacatgctgcatagtcaaaaaattgctcttttccatttatcttgactttcagagctcttgcaacaattacatactttttaatacctccacttacaactacgatacttcccaatggtaaaaaattaactttctctgtcatccctcttcacctcatacttttttattaaattttattgtattatttttcctatttccatttccaatgttgtttagctatcagcacttcaaacatctcaacattcttgtatgattttggaattttaatcatccctccggcattagaatgaatacaaattatttccgcttcattatcttttttcagacttaaatattccacttgaacaaactcgattgacttatttcttaataatttcttttcgattattttgtttttttcaacaactattttatgtcttgttgaagttataaataatataaacaaaataacactgttaatcaagaatattaaaaatccagcaaatacaccataccctgtacatagtaaccacaatatagcagaacacaagaagcccacaccatataaaatgatatacccttttttaggttcaagaatcaatggtgtattaccattatctttcattggaactttatgatttttcaaaacttctgtaacaaacactttatgtgttcctgtagcaaatgctaagatacatttattattctgatatagcttcacattcccactttcatcaacaacgtgagatgtgatgtcctcatatcttatgttatactctttaccattcatttttctccaataaattctatctttacctactttcacatagacacgtccatataagaaactcattaaaaaaaacagaactataagcaggataaataaagctataactaacacattatagtttgatgtcatatttaatgcaaaaataagaatacaagtaaaaccaatccctacaatcatataaatgtttgaaaaaattttccaatcaataaatcgttcacccaattctgtttgtttaataccagctgaaggttcttgtatcttaccgataatactttttacaactataacaattatactatacaataatactttcaagaaaatctttaatacaaatgacataatacctcctgttagagtagagggtgttttacgcccctacatattttaagaatataacggacattttcctgttacttttccgtataaagtaccaaaataatcttccatatattcaactagcgtctgttcatcctcgcttgtatatattggacacattcctttcaacaaatccttaacgatgctttttgttgttttaatcccaaatatcataaatgcatatttttttacagaatccacaactcctgagaatcctgatttgctagagaaaaatcctgattttaatttttccaaaccatatttttttaacaatgaattcctttccgatagtagtctctgttgagtttttctcgttaatgaagatgctttcttaccggctgcttcaattgcatccattttagtttcattctttttcaatcccttaatggtatcttcatatagatcttttgtcgatttagtagtaggcatttttgtcttgctaaatttacccttgagtgcctttactccttttccaataccataaaatgcacctgaaacaactgcacctattacagcatcttccgctactttcttaccatctaccttgccctcatctatgccttgtgaaattgcactattagccgctgctccaactccaccagccgtaacggttagtgctgctgctgctaccgttccaagtcctggaatagcagctactccaccgacgacagctccttccaccgctgagcctgctagtgaaccccattggaactcttcttgttctccttttgcgattttaattccttgtgaaacagcattcacacctgcactggtaagagcaccaacagccgcacccacacctataattgccaatgtggatagtacaaacaacccgttcgcatccgcatattctgttggattatctctacaataaatatattcattcattgataacggatcgtcttgctgtccctttacaaagtcacgtgctgcaaatcttgctataacaggcatatactctctagcttgtgcataataaatgcctgtcacactatctttttgatatcctgtatatccaaaagaatggaactgactaggcgtataccctacatcgcatccaaattcgtcatatgcatatgactccaacacatctccttctggttttaataagcgaataggacttcctaaatcatcatgcagaaaatacgaacgaattccattatcatgaatcattccggatactttactgtcaaataaataagtttgagtttctcccgcctcttctttttgcaagatattattatattgctttgtaatatcaagcacataacgaatttgaacttctgggtcgttcggtcccatttgttgcgttacaccaattctgtgaccaagaccactatattcatatttcgcatacgctccatcggcatttctcgcttctgtcaaacggtttgccacaccataaacaaatgtatgtttcgtttgtccattgcaatctatttgacttaaattacctctagaatcatagatatacttctcattaccatttgagtcaatttttgaaatcaattgatttaatttattgtactgataatttgttacaccatcttttgtaatcatacgaatacgattgccatgtgcatcatattcataagcgtggagcaaattaccatccttatgcactgatgttagttttcttaaagcgtcataacaataagtataatgaccattttcttgcggcatgttgcgacggctctttataatttccgtcttatttccttcgcaatcatatttataaaaatatcgatcaagtataccatttgcatctttatttgttaaagaggctagtaaacctctattatcatacgaatattctgtgctaacaccatttggcattgtctttaattgcaaatggctgtattggtcatactcatacgttgttatgttgttcgcttcttccaaagaagttaatctcttaaattcatcataactatattttacagtctcgccgtttggatatgttatgcttgttctttgtccagacacattatatgcataggaaacttcctttccatctggatatactatattaagtgcacgaccaacagcatcgtttttaatggttgttgttccaacccaatctttaatctcctctaactggcgcaaaacattatacgagaggaacacctctttgccatctgcatactgaatatgttctacatccccactagaagtataaccatatttggtcaagtaaccttctttatctatcttttctgtcagatatccttttccattatatgtataacgttcttcagcaccaacagagtcgataattcctactacacgacccaaaatatcacgttcataacatgtaactacttcgttgcaatcaccatcttttcccttttgtacaatttttaccaaattactatttgcatcatattcatattctgtttcattaccaagtgcatcaatcgttttcagtaactcattcttctttgaataaatataatgcgaactatttccattgcaatctgtaacagagataacattaccaacttcatcatatgaataaatttttctgtcaccatctgcctcttcggtcaagataagtctatctaatgcatcatatgtatggcatcgcttatttcccattacatcgatataagcaataacatttccatttaaatcatattcatatttttcagagtttccgtctggatataatatttcctgtattttctcctctcccggtagatatttgtattttattaccaaaccactttcgtcggtaactgtatcgatattacccaatgttgtatacgtatatatacgcatttcaccaaggttgttgcgttccacaagaagatttccaaccttatcatattccagatgtacttcgttattcatcggatctataatatgaatcacatgatcttctgcatcatattcatatttagtaattccaccatttggttcttttacttgcactaatcgaccaacaacatcgtatgaaaattctttacttcccatacaatccgtctctgcaatgcatttcccattaacatcatatcggaattctgttttatttcctaatgcatccgtcattcgagacatatgattatcttgattatattcatataatgatttagctccgtttggaagtactactgcagatacattccacattttatcatattcatagcatgtttcatgacctaatggatcaatcactttttccactttgttaatagcattataatgctgaacagttttagcaccattataatcaaccatttcttcaatcaagccatttccattatacgcataacatctactatttcctaatgcattagtttctttgacgatatttccagcttcattatactcgaatttactctcattacctttggcatcaacaactttgactacacgatttaactcatcataaaaataagcaatcgttccaccaatttgattagtcaatgttgaaatattgcccttagcatcatatgttactgcacttcgactaccatcaggatattgtctctcaatcggtctaccatgtttatcattaataacagtaacaccattaccggttgagtcttccgtgcgcactaagttgccttttgcatcataatcattcttaactttttgtataccattaatgctcattgatagcaatcgccctgaagcatcatacgtcatattcagtcttctctttaatgcatctattttttgtataagatttcctctattgtcatatgacatacgttggattctacccaagcgatctgtatacttaatacattgattcttatcattatatacgaacttttctactgttccatcagcatatctaatctccgtattacgatattgtccatcatgaacaaatatcgtctgaacaccatttcgttctgtctgagtaactgtatgattttcatcatcatactcaaaagacatactcccaccatcagaaaacaactgcctaataactcggaatttcttatcatatatgttttcgacagtatgtatcttttgcgagtttactatatccttaatacgtccattagatgcatattcataagatatatttttacctaatgcggaacatactgttttaatacgcttttcatcactatatgtaattacgacatctcttccggtatggtcaaagactcttgcaagcaaattagtcttttcatcatattcataattcaaacaatctccataatcgttaacaacttttattaaaagtttgtcttcgtcatatgtaagagaaatgcccaaattatttctgttttctattcgtattaatttcttatccttatcaaatatatatgtattatcgtcaacatcctttaaataaaaatgttgtttatcgctagtcaagaaatcagtcgctgtattctttccataataaactccattttcaacagcaaacactttatgctgaccatcttccattataatatctacttcgccatcatcatttacattcaaatatatttcataattatggcgaaagctttttccaagcacagatattctcgaatccttagaattataatagcgatgaaatgacaatggaatttctccatcaattgctaaatcttcaaaatcatagatgaagtttcctgttgataaatttacaggatcaatgctagtttctaccgcatcaggatctgttcccaacaaactatcttctattgccttttctctcgataactttgcttcctgaattttttctaaagatgccgccaacgcagcattcattttttgcatatccatattccctccgtttgggtctatggtatttgccaaatcattgataaaattgattacactctctgaaaaatttacgttctgttgcaatccaccttgataacgagtatcaatattctttacatttgtaaaaatctcttctattctctgagaagtcgtattatttttatcaataatttttttatgatatgcatccaaattgtcaatgtactttgagatactcaatgcaccaaaccagtattggatttgcagcccagcatccccaattctgtcaccgatttttctccataatgttgtttctgttgcatctttaacatattctaataattttttcttagcactatttgaaaaatctcttatcattaatttcaccgccttttcacaaaactttcaacctcgccatttttggcatttaaattcttggaattttgtatgcatccgcccaagacataaaagaagataaatttttcatattactatcaatcacaataactttgcgattaccttcgtaaacttttattgtcaaatttgaacacacctttatttttatattctcaaagttatagtgcgtagcctttccacgccaattaatatgtgtaatattctttccttctataatcaaacgccaatttgccatattcatagaaaaataaattgcaattataaaaactaaagtaaatatcaaagtaggtattaaatttcctgtttccgcacctttttttgaacaaattagtacaaaaagcaaccatattgcaccaatgatacatgtacacacagcaattacaatttttatcacctttacattttctacgataaagttatcattttttgtaaaattgttcttatatgttgcactgttaaatttcataaaaatacgaaccataaagaacaaaaaactcacacttattattcctattattacatcaatcacgctaatccctcctaataaacagaacaagaaattttcttatctatttcttcaactatatcttcatttacttcatctctataaatttcattttttatttcatctatgatagtctttcctgtctctattatgccatacttgattgttcctaatgttttttgtaattttattttctccaacctattccagtattttgcacgggaactggacgatcttgcattattatattgagctttaacaacggcttttgccttatctcttccaaacagatagtccattgtaccggtcttcgcttccggatgaataacatttgatatttcatttgttatcccgccaacaaccaaggttgttgttgcagaccacagcccattacttatagcatgtgtataatccaaatcttcttttttttgaaggactttctgatctaataagtctcctccaaattccactacaccagaagtacctgcaaccactaataaccccgcacccgtgccagcaacggcaccagtaactgcaccttttcctgcctctaatactactttcccaggattaacatccaaaagactgtctaaaacacttttacctgattggacaccatcaattgtctgcgaaaccacttcccccaaagcacctgcggctaaaccaattacagcaccgattacaactgtaggtaaatttccatccctatctacgaaatccaccggattattccaacaatatccatagtgatttaaagtatatggtaagatcacaaaacctcttactttatcctcactgacaaatcgtcctacacttgcatcataacgtcttgcctgcgcatagtagaggtcacctacttcatcagtctggtagccagtaaagccaaaggtctggcttgtgttgttgtagctggttgagaggttttcaccaaattcatcaaatgcaaaacactcctgacttgttccgtatatatctactaagtgcattggactaccaaaatcatcctgtaagtagaatttttctactccatttgattccattcctactacatttccatcccaatagtatgtctgggatgcaccaccttctgacttttgaagaaggttatagtactgacgtgtcatgtcgatggtgtaacggattttcttttccgggtattctggaatgagactagatatcttttgtcccactctgtggcctagtccgttgtatgtgtaagttgctttctttctctgaccatctacgagatcaaatgatgctgtcatctggttcgttgcatcaaaggtaaactcttttaatatgtctgcgcctgtacttactttcaaaagattccctcgattatcataggtataatcttttgtcatagttccatccacttcagatagaagctgattgtttacattatatgtataacttgtcacagactccattctacttgcataattcgctttacttactctgtttccaaacgcatcataactgtatttacgaagcaaagtgtcattttgatgcacttcggtaagtctgttcaattcatcatatacataagcaaagtgcccattatccacttctgctccaacacgattctttatagcacttaccttatttccatagatatcaaaactatatttgtagctttctgcaaattcgtttcctatatgggaaatttcatcaactcttcccattgcattataatgatagttcgtttcaataccatttggtaaaatcttctttgtcaaacgtcctatttcatcataagcatactgaattgtttctctttctgtatggagagatactaattgcatttctgtgttgtaagaatactctgcgcgttttccatttggatagatgactgctttcttttcacccatcagcccccattcatagcctacggtatctccattcggttctgtaacagacaaagctctacctattgcatcaagagtgatttttgtaatcccattccagtcttttacttcattcagcctgcggagcgcatcataagacatttcaacagtcttcccatctgcgtatacgatttcttctatctttccgtggcttccataagtaaagtttatcgtataaccatcacgatcagtcttagatgtcatatttccatttttgtcatactcgtaactttctacataacccaatggatcagttacactcttgatttgacccattacatcccatacaaagtctgtattctgactctcttccccgtttgcaccggtacaaagagtctttacaagacgattcatcgcgtcatactcataaaaagtctcgttgcccaaggcatccgttaccttcatcaggtttccatttggcgaataatcatacgtggttttgttgcctttttcatctataatagaagtaagatttcctactgcatcataagtaaatttccttactccttctacctgatttactatttctacaagtctatccaaagcatcatatttaaatgatattttatcctccatgccatttgctcgtgatatcaaattgccttttaagtcatactcatagatttctccagaaccatctggattttttacactctttactcttccacctaagtcataggtataaaacgtctgcgttccatttggatgacatactctctctacttgccccatattattatagaaaagacttgtcgttgcaccctctgcatttgttctgctaatgcgtctccccaaatcatcatatgtataagatgttacatggtccatagcatttgttacagctaccagattcccatccctatcataagttttttttgttttagctccatctggctcaattacttctactaattgattttccgcatcataaacatatgctgtagtatttccttctgcatctgtaactgatgttctgtttcctaccgaatcataggtatatgtatttgttccaccatttgggtattctacaagactaagacgattatcttcatcatatttaaatgcctgtatagtcccatccggcatggtttgtgatgttatattccacattttgtcataaccatacgtcgtgacatgcgcttctttatcagttatagtttctattttccctatcgcattataagtagacaacgtccagaaaccatcaaaatccttgattcctgtcaccctgccagctttatcataagtgtattctctcgtatccccaagagggttaattacttttgtaattttacctcttaagtcgtatttgtactttgtactattgttatttacatcccttgtttcaacaactcgatttaattcatcgtagatgtaatgcacttcatttccgtttgcttctctaattgttgagatatttccccgttcatcatatgaaagcatagtcttactaccatcaacaaatgtcaactctacaggatgctgcttctcatcgtaggttatccataaactttctttcatacaattttctgttgcaattaattttccttttacatcataatgattcttcaaacgttcttttccgttcatgctaacactaatcaaattattattagcatcataggtaaaattaatacgtctctttaaagaatccacaacctgagtaagatttcctctattatcataagccatgcgctgagtacgtcctaaacggtcagttttactaatgcattgatttttttcgttatatagaaacttttcgctagtaccatcctcaaaaacagtttctgtgttacgatagttttcatcatagaaataagtggtcttcactccgtttcgctctgtcagaacaacacaacgtttttcatcatcatataaaaaagacatcattccaccatctgggaaaaattgttttgtaacacgatatttcttgtcatattcattttttacagcatgaatttctcttgcattcacaacctcaataattctgccgttacttccatacgtatatgtatagactatatctaatggaagtgccactttttctagcataccgtttttataagtcaaatctacacatctgcccgtatgatcctgcacttttgtaagataaccagagctttcatcataaaaatattcaaaacaactttcattgtctgttttcgcttttactaattgatttttttcattataactaaagctaattcctcgtccattccaattttcttgacgaattaactttccatctgatttaaataactttctttcttttccaatattctccagaacatatcctgtctctgtttttttcaaaatttctaaagcagaagtattgctgtgataatttccatcattatctttttcataccgaataacctgtccatccgcctgtcgtattccaagaacgccatcatttgaatcttcgatcagcacttcataattatgcaaaaaacatttaccaagagttccaacccttgtatcctttgaattataataacgatgaaaaacaagtgggatttcgccaccaactattaagtcctgatgatcataaacaaaattacctgtactaagatttaccgggtctgcactcatttcagctgcatctgggtctgttcccaacatactatcttcaatcaccttgttttttgataattgattttctctaattttttctaaagacgcagccaacgcttcattcattttctgcaaattcatgttcccgccatttggatctattgtatcagataaaacttttatcatatccgtaatgctattggcataagatagttcttgaccaagtccattctgatatcgtatatcaatattttttacgtttgtaaatatttcttcaatcctttgggatgttgtatcgtttttgtcaataaccttcttatggtattcgtctaaattattaacatgcttagaaatatccaatgctccaaaccagtgctgaacttgtagtcctatatccccgattatatcccccagttttccccatactgtagtttctgtaacatctttaacataagctaatagtttttgctttgcactttccgaaaaatctcttatcatttcattcactgccttttcatttatcttatttatttttcttgaatagttgcagtagcctccgcatccttattttcaacagaagatttccgttgtctcatataagacaaagtgtttgccacaagcgtcacaaatgcattttgtatatcctgaagagatttcgtgagttccaccatctgtgcaattgttccaccaccattatcaccctgatccacaggattctttttataatttacccattctgtatgtaagctatttaattctcctatatattggtcgagtttttcattatcaattttcgttgccatttcataaacctcgctctctaatataaataagaatctgcttcatctacttctgataaaaatgccaagcacattccctttgcttcttctcccatatcatttacgatatccttcaaattttcaacatagtcaacaaagctctctaatgcttctgcagtcgcaccttccataatagcagctgccaaaatattatttaaaatagcagtatatttgtctatacctccctgcaaatcatatgcccacttcgcaatttgttctgcttgagaattaatatagtcatcatctatttttaattctgtgttattgcttgccatcttatcatctccttcataatcaattattgcttgctgattcagctcttcttctttcttctgcccttcttcttgcttcttctctttcctgcgcttcaatccttctaatagtggcattcatattagaaattgtgttattacaattatcaatagaatttcctaaggttcttattctgttttgttttctagtaatttcttcttctattcttgtaagcccatttgctaaaccattatttacagagttgtactctgctccagcaaataatgtattcatattgttacaaaacttatttacaatctttgaatttattcgcataaccatacttgtacttgataatctattgacacttgtgtttttgcaactggaaagtgtacttttaagagtagaaactttacttttcgtatcattcaactcacgtatttctctatttaaagtattaatttcattctgatattgatttattaactgtctgtttctcgaaatttcgttataacattgagatttggtcatttttttcacctcttgctcgatttttgagtttaccattagcaacagtaattctgttgctaatggtttcatttggagaactaataaaattagcctctaacagctgctgcgcctgcagcatcatcatcctgacgtgcttgcatataactctgaatataatcagaaatactttgaactgcttcaataacgttttctaatgcaggtttgtattcatcctcaaatctctgaatgaatgcatctgcagtttggtttgtccaaccttcttgaagctgaccattcatggtaaccaatgcatttaacgcttcgttaattgcttctgcttgattcccatatgtacttacacctgttgtgagcacctcgtaatcgactttgtttactgccattttttttgcctccttaaaattttatgtaaaactgttattacagtttttaccattaattaatcgttctaatcttcttcacatcaccatcttcaacaagatatgcatcccctgtctctaatggctttgaatattttcttgtaagacttaacggaatatctgtagtctttatgtttgaaatttcatcgaaaataatatattttttacgttctttaataattttcataatttccggtgcattaaatggaatacttgcattgttgatatcagtaaacacaaatataaccttcattccactatatttgccccatatatcttttaaagtcgccattgcattcttgttactactcaatgctaaaattgcatcattattatccacaataacaacaatccatgattcatcttgtaaattagagcgcctattaatgtaattctgatatcgctgctccacgatttgtccaatctctgtaacaatactaattgaactgtctgcatccgttgtataatatgctgtctgtggaagtatttccaattcgccccatttgccagccaatgtatctaatacatacaactctgttttgccgaatttcttatcagcaaacacactaatgatatatttagcaaaggcttttctactaacatcctttttacctgacagaactatcatatcgttttcattcagattcatgcttaaaggctcaatcgtctcatagtctaatccaatcattaattcatcattagtattcgcttgtgcataatgcttttcgacatatcctatatctaagcattttggtatttctggaattacccttgcattcattccaacataccgttcgttacaagatgttacatatttttgaatattctggactctttcatattccttatctccgtcaaatgcaagatacatttgacactcatatgtggccttgtctatttgcaccaacgccctcccaggcacatttggtaatttagtacgattaccttcaaatagcatagtatattctgatgactcattacaaaataaagcaattctcccctcaaaattattaagataacgatatccaacacctgccgtttgaccattagcaaccaaaaaactaattcctacagaattaccatctctacataccggtaataacatatcattatcttgtaaatataattccttaagagccgttaaattatcaattacaacaactatttgtggcaaatcacgatatcctgcctctttgtaagatgcaaaagaacttactcccacttctgcaaatctcgatttacgaagatcaatttcattagacagcaaacggaatagattctttaccttttcatcttcatgagaaagcacaacaccacccacatgattcagattttcgaaattctttaaaatcatggatgcgaaatctacaatataaatgtttacctcatctggagagtaatgttccgtaaggctacgaattgctgtttgcaaaaagtttgtttttccggtttgagtcgaaccaatcagcatataattcattgcagttatattcagcttatgtgtcatctgtgactggtgatctggatcatcaaccaaaccaaaagtcacaaaaatctcatctgaatccactcttttaccagcatcaaagtataatgtttctggtaatggtggcatacaaatatcagctaatttcttaattccttccttattgcagtaatcatgaatataagcaacaattgcatcaagctgattctgaacattaattttttgcttcctctttttccttacatagattggtttacggtttccagtaaaccctactttagagattacaaattccttttctacctcactagcatcaactgtcgctggtgcaccactataagcagactggaacaactcgaatatctcattattccccacctgcaaatatgctctaccaggttccttaatttcagccgccaatggcgtttttataacttcgttactgtcttctttcgactggactttcaagcacagtttaaatttcgaattcgaccatatctgtgcgtctaccacgccactaggtttctgtgtagccaaaatcaaatgcacacctaagcttcgtccaattcttgcagcacttataagctctttcataaactcaggctgttctgctttcaattcagcaaattcatctactataataatcaaatgaggaagtgcttccgtcactttaccatccttatacaattgaatatatttatcaatatggttaacgcctgcactcgcaaaatgattttgtcgcttcatcaattctgctttaattgatttaagcgatctctgaatttcattcccatcgatatttgtaattgcaccaatcaaatgtggtaagtctttaaactggtttaccataccaccgcctttaaagtcgataattacaaaaccaatttcatatggatggaaataagttgccgccgataaaataaatgattgtaatatttcactcttacctgaacctgttgtacctgcaactaagccatgtggaccatgaaacttttcatgcaaatttaaacatacaacgtcatttttaacatttattcccaaaggaactgccatcgtttcataaatcttagaatcattccaacgggtcttcaattctaaatcatttgcagaatatatgcctaatagttcgaataaagaaatatttttccttagagaactttccaaactaatttcttcacaataaactggcgccaatatatcaattgctctttgcactttatccgatgatacgcaagcatatttaaattccgtcttatctgttttgttttcgcttgcataagtataagccgaataattttcttccaatactactatctgactacaatacaatggcaaatacttcttttctgtttcaaagaatataaaggttgtattaagttctgatgcatgttcaataaatcttgatattggatgacttttgataccgttatcgtttaatatgaaaataacattatgtcctggaacgcctttgtgttcacttcgataagttaattctttatataaatactcaaatacaatatttttactttctgtatcgcaaacaatatttctaaagtttggattaggttgaatatgtggaataagttttaaccaatcatattcctgtacattatcatcgataaaggcatatacattaacatcaccaaaatactgtctgctaataatatctattaaaagacacttaatgaattcattctgtctttcttttctgccgattataccaatagcatttgcgtctttagcctttatgtagattggtgcattatctatatacttatattcttccgatagttgcgttggtatttggcataaatcatctcctgtatccagcttttcctgttccttgtactcaatttttctttcagcttctctctttcctacacccaaatatatatcgaggaagtcttcatcttctggagttctatcaaacaattctgcagaaaatgattcaatatgttccaaattttcttccgtgctgtaatatgtatcacgtaatatttccaactcgctattacgagcagctataatttcctctttcttctttgcaacataattaaggtaaacatttctacgcttctcgcaatcttttttatatttattttgaccatgaacaatgtttaaaacagaagtaataacacccattcccattgaacaaatgctaaagattacatacgttcctcctgattcactcattattcctcgtaatacaacgaccaatgcaaacattacaatcgttggcattagtgatgtaacaatatttaattctggttttgttggaattgtatctggatcgagaattttaatcttttcatcttcaatcacagactttgctcttgtattcctgataaacattggatatacgccaccaatatctacctgctctactatttgactaataccatttaagcggatatttcttttactaaaataaagttgcttatctttataatatgctgagaaatcagccacggaaataaagtcaaaatcttttagcacagcttttttacttatacgcttaccatttacatatgtaccatatttggaagctttttctatcagttctattttattatttgcttgtacaatcgatacaaatgtatcttttccgtattctgtggataattcaatattagcaccagatttatcacctatactcagttctgatatttgcgacaaatcaattttcaaactataatccgtaccatcagaaccaaaatcaatcaaaaagcgaatctcaaatgcaacttctccagaattcacataacagatattaaccacatcatcatgtgtcaattctgaaaacagtaatttacgtacatcgcctctgctgatgtacaaattatcgctacataatatattccaattttcttttttctccagactaatttctatatcctcgaaaaagaaatctgaatttaatctaaattcacagtttgacgtagaacctaatttcacacgttctagttctgctgggatttcaaattctttatagaaagtctgattgcctacaattaacttatattgaaaatccacgcctaactccttttaaatattatctttgtgccatttctgattccgtattctgacaactctttgtttccatgcaaaaatgcaattggattctctgctatcaaataacagttaaatatattgtccacatccatctccaagttaaatgcttcatttaaggctattattaagtcattggcagtaatgtttattggaatttctaattctacattttgtttagcaccttcattaataaactgtataattactttattattcactgttacccaacacctcctacaaaaagagataagctaatttttgaaagccagaataattaataaaatcagaacagttcaattggtcataatgcggcaaatgctcaatgtactcattgactgcatacttcaaattacattctggtgaaatcaacgcattctctatattcttatcaaaatcattacatatacataaatacttctcgttattaacgccattgatattagacattaaagtgtttacagccataaccgacatcctattttgtttcgtaacaaagattaccttatcggctacgtttaataaatctgctttaaattcgtcaaacacactatctgtatcaacaactatataatcatattcgccagatttttttgctgatactgcaatatccatataaatattcttagacagtccgaccgacatgatagccgctttaaatggtggaatgtaactaaatacttcttttctaattacatgttttatatctgcatatattgaatctgatggatttaataactttgtatatatatctggtgatgatattggagtatcgttttccaacatatattgtgcactttgaagacttgcagcttcaatatacagcactctcttataattctgtaccaaacaagccgctacccccatagccacagtagtctttcctacacctccagctgcagatgtaaccaaaataatctgagtttccttcttctctacagcagcaacatttaatgcccccgcactctttccgataatctcattaaagatttccttaatgcttgtatacttaaaaatttggtttacatttaattctcctgtaccgccttcatcatactgctccatcatcacaaaaatgttctgaatattatgacgctgaaggaatgaatcgtataactcttctgaaacaatcaagatttctgcattctgtggttttgaaaaataatcatcgaaatatgctctatctgtaataatttctaaatctattttattaaaaaaatctgttacaaacttaaactgcagcggtactatgtagtttgcatcttcatctgcaataatcactttaggtcttgccattttttacacctctttatataatctggaaatcactatccgccatgcggattatatctccacgattaatctgaactttctgtcctggattcaatcgaactccatttacaaatgtaccattggcacttccttcatcattgatgtaataaatgcctgtctgattagttatgcggcagtgctttctgctaatcatcctattgaacggaattaccaagtccacccattcctgcttctttccaattacaacattatctctatcaatcactaattcgaaatggctaggagcgttcattgcaaccagcttaatatttccactattcttgaaggctgaaggcgtctgattattgttaacttgttttgtaataggtggagtcccgacacttcttgatttgttatacacatcttcaagtgacatagacccattacacaaatctaggacaaactgcttaagtctttcatttgtttctaaaatcaccttattaattagttttactatactcgatcttaattcactttcaaattctgcatagctatcaaacgcctttacactaagcggcaaatataccaacttaacctttagcgtgttctgttccacatatattttatcccaggacaagtcaatactttgacaagtcagaaatccgttatttctcacttctataacactggcaaaaagattcacaaccacattaattagtgtatcagcgcttatccccgcaaacattgacgacattggtctatactcatctgttacataatataaatcaatcaatccgtttctggtcattttcatgcactttacaaaaataccattgttttggctctgtaaaaccttataatctgtattaacaaaatgtgcgttatcttttaatatgtattcgaaattattaccacaggtaatctcagagattacaccattgtcctttaatgtgtacataatttgttccttctctcttatgttactatttgcactatttgccacaagtagaaacttaagcatgtaaacttctacttctgtcaaatagaatatggattcctgcgctttcgcgcaggaatctgaatattcaattacttagctgccttagcttgttttctctttctaaagaatactgtcgcacctgctcctccgcctataacaacaactgctccaccaattgagccaaagaataatgccttattagcgaaccatcttacgaagatatttgttgatacgattacagaatcattaaatacatatgagctctcaaaatcatccgcatctgtatctgtaatattacctgccatatccgtcactactaatcgaaccttctgtgaacttgaattttcatccagtacgaatgctccagaatagttatttgaatcctctgtaaaatcagtaatattctctatctccttgccatctacataagcaacaatagatttgagaccaattgtgtcatatacagaatacttgacattctgctctgttgcattgataacattgtcttcaaggcctgtgatacttgtgatttccggctttgtactatctacacggaacaagatgcctttgtcatcataattagtattttcagggccatttcccgtattgtcttttgaagaaactgcaatcttataaacaccatctgatgcaaaattatctttgctgatagtatatgtatactggaaccagccgcttgcgcctgtagtcacattttcatttatgtccggtgttacagaataatcgctgttttctaagggcttaccatctcttgatatctcgatatttaatgaatcttttacaagacggtctgcattatactctgtgattacaaaatcatcctcaacactctgtacatatgcgccaccttctgcaatcattgatacgagataatcactgtactcgtaaacagatccaaatctattaactgtaaatgttgcactcttctcaattgaatggcccgctttgtctttaagttctacggtcatggtgtatataccatcattttcagccactttttcaaatgtgtcaaaggaaccatttcctccggtttcatttgttgaaatatgtccggcaacaaacttatccgttacatctacattcttgtcagcaaagctcgttcttgaaatcttaacatcacatgattcaaagttcttatcttcaaatgagactgccggaacaacttcatccttaaacgccttaccatcggcttcctgtccattaacagtaattgtagcctcagtaatctctgtatcaattgtcatctgctcagatgtgtactcctgcatagcattagttgatttgtctgaataagtaattccgaccatgtaatctccatcgcctgataatgtgaatgttcctacatgtacatctgtactattatcgctccaattcgcagctatctgaactggtgctccatctcttgtaaccgaaagctgaacatcctctgagtaaaaattcgcttcatgaacagttactgttgcggtaatatcaccatcataataggatactccgttggctacctgtactggtgtgttatactgaacttcagcatttggtgcaatattatctacaatgattctctttgtatctctcaaataatcagattcattatttgctctgtctattgcagtaaaattaacagttccattaaactggctatctggcgctaaagcacttcttggaatttcaaaggttgttgttccaactgcgccaccattggagtttgtaattgatgatgcatcaatggttgcatcaactaattctgtatttactccacttactccatctgctttaacataactgtatttcatagaataaattccagtaatattatccgttgcagatatagtcactgtagcttttgcattataaaagccaaaggtaatagcgtttaatacagtatctaagagacttgtactgtaagtcacctttaaatctgaaggttttgatgtatctactgtaaaatactgctccgcaaaatcatctgcttcaatagttgcgagatctgtatatgcaatatcaaatgtgtaatttgcatcccctggatatgtaatagtaacaatattattgtctccatttgatgtccatgatgatgttgtatacagtgaacttgcatttaattcatttcctgctacatcctttgcaacaatcgtataattcacatctcccggattgaagttatgttcgttaattgtaattgttgctgtctgtgcagaagcaaaatactttctagtgtgattctcagtatcggtcagttcattaattacattagaatttgaatactcaacattaataaccggctttgtagtatcaattactttcacactagaggtgtatgatgtcatctcattattactacgatccttatattcaacctggaatacataatcgccatcatttgaatgatcatcatttgcgtcaatagtatatgttccaacatgcacatctgtagaaacatccgtccagacaggagtaatatcgattacatcattgtcatttttcttaagctgtattttaacatcttctggatagaagtttgcttcagtaacagtaaatgtagctgttaagtcttttttgtaataatctttttcaccatgagtattatctgcagttgtatactccgcagacattgttggagcaatggtatcaacaacaatcacatggttatcatctgtgagtttattacttgaattgttgtatttatctgtagatacaaatgcaatacttcctcttaactgttctgccgtttcttttggaagtgtaactgttgctgtgaattttgtcttatcagtattatcctgaactgcagcaatttttgcatctgcgtattctgcaacatttgaattgcttgctccattttctttcttatagctccaagtgaaataatcaattccagcagtattatcataaccagtaaatgttacattaacagttggtttatagtatccaaatgtaattgcagacaaaatagtatcaactagcggatttgaatatgcaacactcatttttgcaatatctggtgctgtcctatccacaataaattgttctggcttaatctctgcagctgcattaagagctaaatccttataattaaaagtcaagtcatagattgcatcaacaaattctcctgatattgttgccgtatgaacatctccattacttgtccaatcaagatttcttaggtactgctgtaaatcatttccaatcacactttgtcctgcaatgtttttagtgattacatcaaactcaatatcagaagctctaaagttgtgctcggtaatcgttactattgcactctgtggattttctgtatctgtataatctttataatcaaattccagaacaggtattgttttatccaccactacagtgtcagaaatataagaagtcattacttttccggaacgatcttcataactcatggaaatcacataatctccatcctccgaaagagttaactttgcctcattttcatcaatattttcagttgtttcccatgataaggtctgaagttgatttgccccaccattcttagaaacgaaaatctttacatcacttgcaaagaagtttgcttcaacaatatcaaacgtaagaacaacatcatttgagaaataatgtttcgtatcaactgtttgagtcgttcctactccgtctttcaactgataagatactgtctgtgtcggtgcaattgtatctactacaaacacccctgtgtctgtataggaatcgcaagtattatcagccacatccgttgcagagactttcagattacctcttaactgttctgcttgatttcttggtaaagttaaagttcctacatacttggttgaatcatgagaatcacgaatagcttctactgttcctgaatcagcttccagtatacttgtacttgatccatccgctcttgtatattcccaattaaactttgacacaccagatgtattatcataagcagtaaatgttaccgtaatttcatcaccatagtacttgacatcatccttttctgtcgcctcagggaattcaatgccaacattatatggcttttcattatctaatttgttaacagatgtaacaattttctctgtaatttcaccggtttcaatatgtttaaggtagattattctatcaccaatcccttgatcctgtgcttctgcatcctgcatctcaccatacttaacacttgcagaaaaagtaggaacaccggttgagatattatcactacgaacaattgaatacccactcgccggcatgatttcaacagctgtgttaaaccagtcatttgttccatcagggccagttaatgctgtattcaaatcagcaacatcataaacagtgtatgcactatccggtgccgtacgaagtgaaatccttaatgtgtatgatacgctatctgctggccatttcacattatttcgccagcctctcacctctgcttttgatgctgtaattgtaaccataagattattattagcattctcaattgcgttaattaccttagaataatccgatacagttacaacaccagaattagaaacacttaatcctaaatcagtattgtcttcaatgctatacgaaattgcacctttatcttttgaaaatgttttaatagccgcatttgcagttattcccgagctatttcctaacacatattctattgaatcagttggaaatgaaacgtattctccttcactactcttttttgctgtaacatttaaaatatgctgaattgtacaatcattgtaattatcattacctgtaagtgttgccttaactgtaatttttcctgctccagtaacagtcaattcacctgttgttgaattaatcgtagcaatatcgccatcctcagcacctaattcaagcgaataacttattgtacctcctgctagtgctgcagtgtctgttgcgccaaaattaaaggtctttccattcgtcaaatcagctgagcctatttctactgatgattcttcattattatatttagaatctgtgaatgcaaaggtctgctcagctttggcaatataaacattatacggagccactgcattatcggctggagttacctctacatccttgtcattataatttgcctttactgcctttacccatacaatataagaacctgcattagttacagttggaatgtcattactccaagcattgttatctaccgctaaatcgccatcgtctaactggtactttaaatcatatgagccttgattactgactgttactgcatcctgtgggttgcctgtataagtaccgtccaagccagttacacttaatccatccaaatttaattcagcattcaatatggttgatgtcacttcttttgtaaatggtttgtagttacttcctctatttatttccagttttactgtataacttcctgctgctaaccctgtaggaatacttctgtctccagttgctgtattattaacactccatgtaactgtatctgtatcttcaaaatttcctgtgagagttactaattcctgacttgtattttctacataattaaactgctttgctgttatatcaatatcaggaatatcaatggcattaatcttagcaattttctcacctgattcatatgtattgtaaccatcttttgttattcttacataaactgaatattctgccacatcagtttcttttggaatctgttctgaccaagttgaattatccgttgagtattcaatagtcgcaccttccgtatctgtatcaaccgatgtaataagttcttgctcttgtcccgtatagtctgcatctaatgttgttattgtgacattttcaatatctggcatagttaccgttttggacaactgtactgaaaagttcgcttctgaacttgaaatggcagttgaggaaatagttgcattatcatatcctgtcttagatacagtagctgatattagcaaacatccatctatatactgcgtagcatctaatacttctacaacaccatactcatccgtagttcccgtgctgttaatggtagtaaatgcgtccccgtctgtaactgacggatctttcataattgaataatcgacatttgctccctgaattggatttgattccccatccacaaccattatagttacatatccgggatgttccgtggcagcagcaaatacatgacccattgatggcattaacgatataaccatcaaaaatgccataaacgatgccaacaccctctttaccatcgagctttctttaaacattttcattagtccttccttcacatattttaattattcatacttaacctcttgataccattatacaaaacaatggtcacacaacggtcacacggagacaactttgtgaaaactgcatattgaaagtaccgaaaattgcatattttttagacaattttcgtcgctttttcgttattttttgtaaaaaaatacctattatttattgtatttcttgtatatcttttcaaacgcaggcatggggcactatatcacttcttccgtatgaattattttcacactgtcaatcagcttaatagtgatggcatttgcactatctaacggagcagttttggcgtttccatccagtagcattgtttcatcctcaaccagaatttctgttgcctgatcatcaaaatctcttgccagattttcattcaacaaacccgtttcggcatttgcctcatctgattgtttcatcccctccatcgttccggtcaatttacctctttcaagattgcttttactggttttatacgatttattaccagttttctcgttatttagacgcattctttcaatagatttctttgctgttcgtcctgataaatctcctattacgattggaatcttaaataaaaaccatagagcaattgctaatactgcaaatacccctgccgcgataaaaaagattacagaaacagtatttagtatatctgccatagttacttcctctcttctgcattagtataagctctctcaattgcctgcctgtatttctcatagttatcaataatttcattctgtaatttcttagattgttccttttggacgctcagattttttgccaggctattcacttcatccattaaggatagtatttgttgttcgtctacattaacctgagccatactgcttcgttgatcatacagtagcataaatactccgttatataatgaaagctgatcatatgcaccggcatactttacatcatttaacgatgattcaattgtttttaacaattcatcataattgtcttttgatgcctcttcaacgtttgtattacttaagatatattttttataaaaactacatatctgataatagcaatccgacgttttctgttgttcaaatccggtagcatttgtattgttttcacaaaaaaattcatacgccttttgcacacgtgttgaaaaactatagctgccatcctcttctgtataatagttaaaatacatcatacctattttgtaattcagctcagccacttccttggttgtattgtcaaattcgtccttatgtgcattgtagaccgctaaaaaagtatcattttcgtttttaccaaatttaccttcatcctcataggcttctatcatcttaaagtatgcatctgtacgcataggatatatatcaatggctttcttataattagatattttttcatctaaagatgatgctgttgaggttgataccaaaacttcataatcaccattattcatattgacagacaccctattacaaaccactccggatatcacacaaacaattgccaaaacaatcgatgcaacaaaactatttaattttatcttttgttttttcttataatctctggtaatcagttcagggtgttccaaatcataaagaagatcctggcaattttgatacctgttttccggggctggttgaacacacttgtcaataatcatttcaacaccttcggaaacctccggattccacattcttaccggagcatatgcctcacctgttctaggatcaattcctgttagcaaatgatgcatcgtcattccaagtgcaaaaatatctgaacgggcatctgtttgtccactatattgttccggcggtgcataacccttggttccaaggactgtggtgtctgccagattttgttctttatactctcttgcaataccaaaatcaataatcttaatatttccttccggctttagcattacatttgccggtttcatgtctcgataaataataggtggtttctgtgaatgtagatatgaaagtgcatcacacaattgtttcgcccatccaaccactaattcttcaggctgtgctccatattctgcaagaatcttatctaaagactcgccttcaatataatccatcacgacgaatattgtgactccgttatcaataatatccactattcttggtaacgaaggatggtccaaacgtttcatcatgtttgcctctgcaagcaaactattaactattacttcgtcatttcttccattacctttttttcgaatttctttaactgcccactgcttattcaggtgagtgtccatcgccaggtaaacaaccgacattccaccatgaccaatttcagtaagtatttcgtacttaccagcaataacagatcctatttcagccatataccatcctcctagctaagttttattaaaatgaccgaaatattatctttttcatttcgttgtttattcaattctattaggtattttgcattagactgcattgttttcttattcaccaaattaaccggattcaatgattcaagcatttctttctctgtaatctcgtgtctgaaaccatcagagcacaacatatatgcgcctttttcctgcgtcccaatatatacttccggttcaagggtgtctgaggcaccaacacactggagaagcatatttcttcttttatcattttttgcctgttctacagtcattgttcctttttttatttctctggcaacaaaggtttgatcatttgtcagctgtgttatggagttatccaaacgataaactcttgtgtcccccacatgtgatattacatattgattgtttacgaacaaaatccccgtaaacgttgttcccattgtaatgttttcattccttgaatattcaataagctttacattcaggtctttaagcatcagattccattttccactaataacatgcaaatccaactcttctaattcatatggaagttcttcatcaaaccacttgtcaaatgcacgtattaccgtagcacttgctaattctcccttggaaagacctcccattccatcacacacaattgccattaaaacttcaccgccagaatactgaccatgttttactaatatgctatcttggttcgtatcttttgttgttccaatatctgtctctgcaataaatgtaaagtgcatttcccactctccaatctgacttaacttctaaactcaaattcatcatttgccaaacgtattctatcgccgaaatggatttccacttcttgctgaaccgggaccggaacatcattaatatacgttccattttttgaatttaaatcaactataaaatatctgcctcttctcgtaataatatcagcatggcttctgcttaccttatcattattagcaacgaagtaatctgaatagcttctttcttttcctatcctaaatactggtttattaattgaaatcacttcatttgtcagcaagcgatatagcgaagcataatgaacagtctgctgttcttccatcaatagtcctgttgcctcatcttccaccaatagtcctgttgcttcatcttcaagcagccctgttgcctcatcttcaagcagccctgttgcctcatcttccttattgctgtaatgattatagtaatctgccggtttatcagtgatatatccactttgtcctacattacgcctttttattgtattaacaacgcttcgatcctcattctgtatatacttttctatcttattggcatcaaacttcgttagtgacttaacaaagtaaacatacctcgacacatattccatatcattttcctgttgtggcttacttgcatatataatctgttccataaaaccgataatgtcagtttccttctgaacattttccaatggtaaataaataaactgcaattcctttgttatttcattgataaaaacattttttatgtcaaatatcacattattaatgattaacgaattcgcatttaatttttgaactgtatctaccacctgctccataataaacaggaaatcatatttgctaataggcttctttaatcgttcgtataaactaattccaatcggaccataatattcaatatgacttttctttatcatttttactttcaaaagccctctgatatatctgtttgaaaagaagtctaattgcgtaacattgattttttcctttaatgatagtctcactccaactatcagctgacaatcccttgtcttaaccttgtattttgccattaccgttttcatccttttcctgtgaaaacacatataattgcgtagaactattcgttcttaacataaatttgcatagtatattatatttactattcatacttaaactcttgattccattatacaaaacaatggtcacacaacggtcacacggagataactttgtgaaagctgcatattgaaaatgccgaaaattgcatattttttagacaattttcggcattcgcgtattttttattcgttatattcaactattatttattatattttttgtatatcttttcaaacgcaggcatagagcgctttatcatttccccgtccacacagtatgatattctcacccagcccggacagccgaagccgtctgctgctactatgagcacatcctcctcctttgccttctcacagaatgcattgctgtcatcctcgagtgcctttacaaacatataaaaggctccgtccggcttgaagcagtgatagcctatccttgtgagtccctcatacagaaggtctctgttttctttgtaggcattgatatcaccggttgccccctggcattttactatcatcttctggaacaggcttggtgcacacacgtaaccgagtgctcttcccgcaccacagactgctgcatacagctctgccttatcgtacacctcatcaggcacgaggacgtatcctattctctctcccggcagtgaaagtgacttgctgtatgagtagcataccagtgtgttgtcgtaatatttggtcacaaacggtaccttgattccgtcgtagactatctctctgtacggctcatctgcgataatgaatatcggtcttcctatctccttagactttttctcaaggaggtctgagagctttttgatggtctcctcagaatagactgtgccggatgggttgtttggtgaattgattatgacacctctggtgtgcgcattgattctctcctcaagcgcatcgaaatctatctgaaaatgctctgtgtctgcaggcacctctacaagccttgctcctgctgcattcacaaataccttgtactccgggaaatatggcgctatggtaataaactcatcatatgcgtcacttgtcaacgcacgaaagcagattgacagcgatgccgctgctcccattgtcatgtaaaggttgtctgcattaaaatgtgtgccatgtgtgttgttcaaaaattcagctattgccgctctcgtttccacgtctccctgtgctgaggtgtagccgtgcagcgcaacagaatcataatctgtcacaagctcctttattgtgtcgtttactatctgcggagccggtatgctcgggtttcctattgagaaatcatatacattttccttacctacaattgctgctctttttttaccatactcaaaaagctccctgattgctgagcgcacgcttccgagctggtacatgctttcgtttactaccattttcttgtctccttatctctgatgttcttgcatgtttactattataatatctctgcttatgacatacaaatgtctttataaacatctctttatacacatattgttaccattcatgatcgtttatcgtgatatgaatgcctccatcccggcacgcttcgtcatatcaatatgctccttaagctcgcgggctgacattcgcagtgcccccaggctcatgaccgtctgctgctccagtccatcagaggttgccactgttaccttgtacctgtcacgtatgccaaacacagtcttttcgataaatgcatcggctgtctcgtcctgctttgtatacacaacctctatgttgtggaaggtctctctctttccggcattgcccttcaccttgtacgcatcaaacaccagcagcagatgacagcccttatagccctggtaatccgataaaacatccttcagcgcatctctcgccgaatcaatgtttatgcgcgagagctcctttaaatcctcccatgcaaatattatattatatccgtcaactatcaggtactcttcccccggggatttcttcggataaatcggattgccgtgcttatcatgctttacggtgcgcggtttaccacttagaccttcatactcatttttctttttgcctgaccatttgcgcctctgatcctctgcgatatcgtttttgcccatgccaaactccctggcataaacatctgcaagctgcgcatcaagctccactgatgacatacctgaaacagctttctcaaagctcgtcctgcggcggtttccggcaagcgcctgcgcatcttccgctgaaaatgcattctgcgtgcgggcactcgctgcaagtgcctcctcagactcatctccgtggtagacatacggcaggtgcatatgctccgggacctcatcccacggcaccacgtagcctgagccgtgcgcacaaaataccgagcctgtcggattgcggaaatcctcctcgctgtcatagtgcatctgcgcaatcacctccgcaggattgtgacactcatcataaccccacagctccagtgtcagatgcccgagcccctttgtatacgcatgcaccagactcacataatcctgcattgtcgcaaccggtgccttaccggtaattgttgccatctccctcgcagcggttatggcaaactgcgggctctcggctcttgcaaatctctgctccagatctgtcattgcgcggccgacatactccatcggcacctgtaggataaagctgtagtatggctcaagcagcacgctctctgtggatttaagtccctggcggattgctctgtatgtagcctggcggaaatcgcctccctccgtgtgctttacatgtgctcttcctgtaagaatagtgaccttcacatcggtaagcgctgagcctgtgagcacacccctgtgctccttttcctcaacgtgtgtggctatgaggcgctgccagtttttgtcgagcacatcctcactgcaggtggatgtaaccgtgattccgctgccacgctccgctggcgacaaaagcagatgcacctctgcataatggcgcaacggctcaaagtgtcctactccctcgacagccctcgctatcgtttccttatatacaatgctgcccggtccgaacgtgacaacaacaccaaacctgtcctttatgagacgcacaagcacctccatctgcacctgccccatgagctgcacatggatttccttaaactcctccacccacactatgtaaagctgtgggtcttcctcctcaagctgctttagcttttccataaatgccgccggatttacatcatccggcagaatcatcctatagtttagtaccggttcaaggattggcatattggactgctgctcaaacccgagcccctgccctggaaatgtcgagctaagacctgtgacagcaactatctcccccgcctctgccacatcagctatctcatatttttcaccggaatactttcttatctgatcgattttctcaatcaaaaggcctttcgcctcgtcaccgccatgcgctttgtactctattttgtccctgaccttaagacagcctcctgtaacctttaaaaatgtcagcctgctgcctctgtcatccctgcctatcttatatacgcgggcagaaaaatcgtcagggtaatttctttcacacataaacctcgaaagtccctgaatcagcgtatccactctgtcgagcttaagtgccgagccgtaaaagcaggggaacacctccctttgagccaccgcctgcgcaatatgtgcatccgcaagctctcccgattccataaattcatctaaaagaggctcgctacacatggcaagctcatcaaataaatcctgtgaagaaaaatccacgcagccatcgctcagctcgctccttagctctgcctgcactttctccgcatccgtgccctgcatatccatcttgtttacaaaaataaatgtcggcacgttatagtgctttaaaagtctccacagtgtgcgcgtgtgcccctgcactccatcagttgcgctgattacaagtattgcatagtcgagcacctgaagggtacgctccatctctgccgaaaaatccacatgccccggtgtatcaagcatgactacatgccatgtacgagctgtatctgccgtacgtgctacatctgctgtacgtgctgtatctgccgcatttgtgccacacgaaatatcaagccttgcctgctttgaaaaaatggttattccacgctctcgctcctgcgcatcgttgtccaaatatgcgtcctgatggtccacgcgcccgagtgagcgaatctgcccggtgctgtaaagcatggcctcagacagggttgtctttcccgcatctacatgtgcgagaatgcctattgtaatgtgattgtttgtcattttctgctccatttatgcctcaatccaagaacagagacacctgtggatgtctctgtgtcagcctttatatcataatccgttgatttcctaaattatagcattttgtggttggtctgtcatcttttttcttgattgacagcgggacataaaaagcgccgctcaattgacaaatatttattccatacatataatgtgattacggaaatttttgaatggtatgaaaataatgcgaggataatatgaacaaaaaagaagtattggaactaaaacgaagattaaaaaaagaccaggcaaccttcagtcgtctggtcggctgctacgtggactgcaaccatgaaaaagtctgcaaattcggtggcaaatttctcactctggaggaggatgaatactacaaatatctggagatttcaaacaaggtgctttccggcactctcggaaacaacctgctcaatctgcagtttccgcttgaggaggaagaggtcggaggccgccagcagattctcatggcgcttcgcgacagcgagcttaatgatgagactctgctcgatacatactatgatctggtcatcgacacctacgatgaggccgggaactatctgattcttttgtatctcgacagctacgatgtcatgacacgtacaaaggacaacatcaacgttgatgagtccgaggaggtgtacaaatacatgctctgcgccatctgccctgtcacactttcaaagccgggccttggctatctggaaaaggagcagcgtatcggagcccgcataagggactgggtggtcggtgcacctgagacaggctttttattccctgctttcaatgataggagcactgacatacactccactcttttctatacgaaaaataccaaggagccgcactctgagtttatgacaaacggtctcggctgcggtgtggagcgcacagctactgagcagaagatggcttttcattcaatcgtcagaaacgtgctaggtgccgaggacgagagcacggatgacaaactgcttgatatccagcagaatctgtccgagatggctgatgactacgctgagacccacgatgatgacgacgatccgttcattctcgacagcgaggctatgaacaaggtgcttagtgactgccatgtctctgaggaaaagatttcacgcattgaaaaatccgtcaatgaggccttcggtaacaagccgcctatcgcagccaatgtcattgattcaaaggctcttgcagctaatgaaatccgcgtggaaaagcttgctcttgagagccaggtcggcgatttaactctcgagctcaatgagaaaaatgcgcagcttgaggagaaggattctgttattcaggagaaaaataatcagattgaggagcgcacctcacagcttcttgagaagcaggaagagattgataattacactgcccaaattaagacctatgatgtggtgcttcatgtaaagccggagaaggcttcacagattcatgcgcaggtcatcaatggtgagaagtgtctcgtcattcctatgagggaaaatgagaatgcgaccataaatggggtgaatacaagtttataggggcttcgctatcatggtgcttcgcatattcaggctgtgaagaccggcctagcatgcagtatattcctcagaaaaatataaaatcagccacggcatcatttgcggatagtttattgatagtttgctatgaattatcatatcctcattttatggaacgccgtggcagtttatatttttcttcggaacacaccgcatactctccggtaattttaggttatttatgcgaagcaattaacgatgagtttataaaccatcaagttgcttatcttattatataaaatggcgtgtgaaaatactttcgtttttcacacgccctttataatgttatcacctatgaaataatatccttataataattacctgtttaccagctcagcacctcatgaccatcctctgtgacgagtaccatgatttcccactgggctgatggaagtccgtcgtcggtgtatacttcccagttgttcttgtcatctacgtagatatcggccttgcccatgttgaccattggctcgatggtaaatatcatgccgggtgccatgaccatgtcggtgccgcgcttggtgttgtagcctacccacggatcctcgtgaaattcaagtcccactccgtgtccaccgatttcacgcactactgtgtaaccgtttgcaaatgcatggtcgtgcaccgcctgtcccatatctccgaggaagccccacggctttacctctttgagtccaagctccacacactcctttgtgacttcaacgagctttttcttctccgggcttacatttccgatacagtacattcttgatgaatccgaaaaatatccgtttaaaattgtagaacagtctacatttatgatgtcaccatcctttaagatgacgtcctttgaaggaaatccgtgacaaacctgctcatttaccgatgtacatacgctgtaaggataaccctcatagttgagcggtgcagggatgccgcccatgctggtggtcatatcatagactattttatcaatctctgctgtgttcataccctcatggatatgctctcctatgtagtcgagcactgcgacatttatcttggcgctctccttgattcccgctatctggtcaggtgtcttgatgattgaatggctcggtatcttatgatgtgcctcagcaagcttttcaagcttcatatcaaatgccgcatgacaggtcttatatttctttccgctgccacaccagcaagggtcatttcttccaatttttgttgacataaaatcttctttctagtgatcaagagtaacgtttcccatattgactcttttccacactttttcttttattttatagttatttttctccagcagcttcttatatctgcctcccgagaaatcataatccgttatatcggcattgtcaagccctgcatatatttcctgatatttccgggctattgcagacttttccatggacgaataaatatcctttttttcgactccaagcttctttgcaccatctatatcagacaaatcataccagaagtccttctcggaatttttcaaagctgctttctcgtcgtcactaagtgtaatgctctcttttttggccatctcataaaaaatctcatcgtgaatggccatggacatagctgctttgcgcgctgtgacacggacaaattcaccatttgtgtggatattccaatacttgtttggattatcggaatcatacacaagagcctgcttctcgacattcatctcctcatatgccacataaaatgccatatcgcgcaatgtcagctctttcccattcacggtaacagccacgtcttccagatgctcattgtatacaatattctgcttcatatcatgataattatatgcatacacgccggctatgacagccagcactgcaagtataattgttgtgatgtgttttcttattttgcgcaaagctttgcaaccacctgatttatgacctttccgtcagccttgcccttgaaatgcggcatgactgccttcattatctgtcctttgtttcctgttgcgattacatccgaaaactgctctatgagctccttttctacctcttctgccgacatcattgcaggagcgtactcctcaaagattgcatatctggtattgtactcatcaagcagatctgttcttgtggcagggcatgtgtcaatctgctccttcacggatttcatttccttaaggatgaccttgttgacaagctcctccggtatattgtctctgcagccctcatctattgccgcctttttggctgccgatacaagtgaggatatagcatcctttcttaccttgtctcttgctttcattgctgcaatcatgtctttttgtaattgttccatctgcatggcttgttcctcctgcttttcttactttatttacaggcttgctagttcgttttgtgcgaattggtgccgtctgcttctataatacaccttatatacgaaaattgctatcgtttattgcaaggagtttttgacggttactaacattgggtcgtggcgtaagacgcggacatgccaccagccgcaaggggctctcaataagcgactagcggagctgtttagagtatgtagaattatgcacatggaacccagaaatgtcctgccatggacagcagggcaaggtgttatgcgccatggacggcgcataaaagccggtttcgtcgagcatagaaaaccatacaggcataattcgtacagcctcttgacagcatagcgttagcgcattgagagccccttgcggctggaggcatgtccgcgtcttacgcccttactttattggtaacaattcagtactttgtggtaaaaataaaaagagccggtaagtataataaatatacttatcggctcctaaccatcctatacaagacgtcgtatagcaagtattgtatgacactgtacgcttctgtttgctgtgattcctgcctttgtggactgtgcctccactataacaccaccacctgcatatatagctacatgtcccggatataccactacgtctcccggctgtatattatcgaaggatacggcctgtcccacagacttaaatgcctgtgaatatctcggtgtgctgataccaaaatgtgcatatacctcatgtacaaagcctgaacagtctacaccgtttgtaagactgtttccaccccatacatatggattgcccacaaactgcatagcgtatgatactacagagcttcctgaaactcctgttgaagcacccgggttctttccaccgcctgctgcatagtcactggcaatacttccgcccttaccggctccaccaccatcatagcttggactgcttgatgagctgttcgctctggcagcggcagctgctgcagctgcggccgctgcttcctgctcctgaatgattttgccctgtgccgtaatgatattctgataattatctgcctgctgctgtgcctgagctatctggcttgcatactgctccttctggttttcaagagctactatagccgcctcgacatctgcctgctgcttctcatagtcatcctgcatggctgtgagctcattcatgtctttgtcaagcttagtaccaatctccttcacctgctcaactgctgcctgataagaatccataagagcacgatccgaatcatatacatctgacacgtactctatacgattgagcatatctgtaataccatttgactcaataattgctgtccagatattgtcctcagcgctgttttcatacatgaactgtatacgcttcttcatggcgtcatactgctcctgctgcttttcctgagctgctgcaagatccttctgattctgctctatctctgcttgtttatttgtgatatctttctgaagcttcttttgtgctgcaagaatctcatcaagctttgcggatttattctttatatcatcagcagtagtctgctgctgatcctttagaccattaatctcattcttcttatccttgagatcctgctcagcctgtgacttcttcttctctgcatccttctgcttctgtgtcttggcatataccttctcaagtccactgtttatgtatccgctaaatgtagtgccctctactgccggtcctgtaaaaacgagtgccgatgttaacacagtacatatagcacgtgtccatttctgattcattttattcctcctgtaatacgacggtcagattgacctttccttccacaatttacgttcaatatacattcggatatattattgcacaaaataaatcttttttccacatctttttgtaaatttacagaattttccacattttatataatgatatgagggtcaaaaggtattttgcccctaatttatgattcacatgcgcgctattataagtctatcatcaggtttgatgctatctgatgtcagagcatttatttccattatgttttcaacagtggtgcggtatctttttgcaatgtcccacattttatcatccttctgcactatatagccaaccagagctgcttcctcttcagtatcagacgctatttttcctgctccaccgatgttatgactgacacttcatcctgctgcagggcaatagcgtttatgctgacaacacccttaatttcatattcgctgttgtcgagtagattgacctgcacctggtctacctgcagatttacctcgcagcaggtgttggcgtccatgccgggtatctcaacaaactgttcaaacggcacagagtctgtatgcatctctatcggacagccatcgtcctccacaatattcacacagttcacctgcaatacacctgacacaataattcctgtgtctgcattttttatctgtgcaatagcggcctgcgtctttgtaccgcatattcttaaaattctctttttgctgttttctctgtacaactgctccaaaatacggcattttgtgtcatttttcataagaaggctgcataccttcatcttttcaaacacaggttttatcggacatgatacgctgtacatgtcattgagcacctctactgtttcctcactccagacctttccatccaccgcaagtgctgcctcaatcgaaagctgcctgagctctccgtcgtaatcattttccgcctcaacctgatgcatggcaggctgtgtgcgaagccaggcaatatttccggcatcatcaccctcgcagcgtatttcatttgaaaatccctcctgcacctcaaagcaacaaatttcctgttcttcactcagatacactatacacgcatggcactcgcctgtcagtgtaatatggtcacgctcgtatgtatactccagatttctcatatcaacaagacttgatatgagcttgcatatattcggcttggtctttggcaaggtgacgacatttttaattctgacaatatcccttacaacactgtcaagcttaagcaccttcatctgccccataagctgctccacatccttgtcatcaatcctttgtgcaacttcaagattttcttccctctctccataaagctccacgcttataatgcctctgaccgagagttttcgcgaattgataaccccaaccgtaagctcatcaagcccggtatacacacgaaccgtatccttctcgcagactccttgaagaacaagcttctcctgaaacggtattgcatcctttatatgctccaccctgtttccgccgatattttcctccgactcatcgccttcaaaaacttcttctctcgtatacagcacttcaaattcaatgcttccactcagccagatattctcgcctgacgcttttatctcgtcaagctttacctgcccgttctgacaaaccactttggaaacatcaggcttattgtcctttatgacataatccctgtcgaagccaacctgcgacatatcctttaccttttctatgcattgtctgattttttgtgtaattaactccataaaaaataccccacttcaaatatgtatataaaatacatattcaagatggagtaactttatgcagatgcaaatatttaaattcatgatcattataacaaagatgtaacatctttacttcatgatactagcaaagctgcatccttatatcttttgtaatcacatcagtgtaggtgaaagataagagctgtggcggattctgctcaaactcatcatctatcagaaccgtaaacacacttgggtatgcctgctgaataacaccctcctgaatgtcaaccttgttgcggccaagatcctgctggatttttaccctgttgccacactgctggtgaatcgatgctctgacttttctaatttctgtctgttccattttaagcctccttattgtggatatgcccactggcacataactatagtcctcatggtaaccagtattgtaacgacggtgtcatatatatgaaatcaatctctgtataaatataaaacaggtcaaattaatcaacaattatatcaatcaatatatttgaatatataaatatgtcaccacaatatctagtaactttactatagcaaagtatcgcagtgatagcaatagggcattagtactgattgtcagttttttcgcaacttttaacacaatttacgaaattttcactcaaacacaacaggcatttcactcaattccgtctttattactatatacggataactcgcctgattgctgaccttctcgcccttatccggggctatcagacgcgtatcaaaatacattgccttatccttaacataaaactggttaaccgtaatactgtagccacctgtctcctttgtgccaaagccttccgctatgtataaatattcatcatccttgtacgtcagcttcatcgcctttgccttgttttcatttatctgctttttaaactcctccgggatttcatccccgcagatcaccgtgtactcaaccatcctgtcactctccgtgcctgaaatatttgcgcggcagcccgaaatcactgtcgtttccaatataacaagcacacctgcagccatcaccagaaatttcctcaatttttctgacattttttcctctctttcttatcatatcgcttatgatatgatataatatcagtaattattcgaaaccacctttagaaccaaaaagctgttgcttacatgcaagcatgacgcatcagcttttttattctcaatggttctgaatagttacattacattttatattatgaaaaagagaggtcaaatatgcgttcagttttaatcgtaatattcgtatttttctatctgttgctcggtcttccggtgctcggagccatgtggataatacacaaatttgccccggcatgggccgatatggcacagcttcgcctggtacagtgggctttccgtgtcatcatattcctaagcggagcagacattgaatttataggggaggaaaatgtgccaaaggacgaggctgtactatatataggaaatcaccgtagtttctttgacatcataatcacctactccagatgtccacgcctgaccggctacatctcaaagcagagcatcacaaaaataccggtgctgggtctttggatgaagcgcctgcactgcctgtttttggaccgcgatgacatcaagcagggactaaaggtcgtgcttgcagccatagatcaggtcaaatccggcatcagcatatgtgtatttcctgagggcacacgctgcaaaaacaaagatgacctgacagaggtacagtctttcaaagaaggtactttcaagattgccacaaagagcaaatgcaagatagtgccaatggcaatcatgggaacaaatgaaatattcgaggatcaccttccatgggtcaaaaagaggcatgtggttatccgatacggcactcctattgatccggcagcactcagtaaagaggaacaaaagcatctcggagctcattgcagagaagtgattgtagatatgcttcatgaaatggtatagctgaaaaaccgcccagtcgggcggtttttcatatttcttcttcaaattcctttaaactattaaattttattctcatcaactattttttacttcaaaacaagcaccgaatacgccggcagctttgccgttccatccttatatgatggtgctttctttgtagtctgaagcattgcaacagcatcatttactccaagcgatgacacatccacacttgcttcatcctttgatggattaaatataagcactgctttctcaccattgtactctcttgtgaatatacacacattatcatttgacagatccttttcaaaggtatttgtacctcgtgctatctccgggaaagcatttcttattgatattgtctgcttcacaaagttgtaaatagagtatggatcctccatctgcttatccagggtatcatatgtctgctcggtttcttctgcattctgaggtcccacacacattcccttagcttttgaatccccgctccatctcatggcaagacgcttcgtctcatcattggctgtgcctctcatgccgatttcctctccataatacagaaaagcatttccgggcataagaagattcatagcctgcgccatcttggttttctcctcggcattatctccgttgtagtatcctgcgctgcgtcccatatcatgatttgtataaaaaggtgcatcaatgtatgagtctgtatacttctttatctcattttccacatcaaccaaagcattgccgtatgtgctggcaccatgatttgctgcaccatttaacacctttccaatatatccatcctgctgtgaaaaatcaaagttgaacatactgtcaattccactcttatagtacttcgcatactctctgtatgtagtccagccctcaccaaccatataagcatcggcctttttgctcttcacattgtttacaagccatgtgaggtcatctatagtctcagtctggttattattattgtaataaatcacagcatccagtctaaagccatctactccgcggtcaagccagaaggatgtaaccttgtcaatctcccctcttacagcttcgctctgcaggttaaggtcaggcatgctatctacaaactgtgactcgtaataccaattcgtgcccggcagctggttgtagcctccgctattggttttgctaaaattatagtaatcaacataaggacattccgaagaatccggctctgccccatcaggaagcgacttgatataatctgcagccgccttaaaccacggatgctcgttagatgtgtgatttattacaaagtcaataatcacattgatgtttcgcttgtgacactccgtaataagcgcatcaaaatcatccagagtaccatactgcttgtcaatattcatataatccgtaatatcatacttgtggtatgaaggagaaggcataataggcatcatccagatttcattgcagccaagtccctcgatatagtcaagcttctccgtaagtccctttaaatccccaatgccgtcaccgtcactgtcaaaaaaactgtatacgaacacctcatagcaggtcctgtaattgtcctgaatcacattaggatcatttttcgcattcatctgctccatagcagaaggcttgtactccttctttgctgccgtctcggtattctttccacccgcagcacaccccgcaagcatcgacaccgccatagctgccgtcaatgccacagcagtcaacctgcccgccaatctattcacagccctgccgaccatattgcggccgcctattttattattaatcatacgcactccttttcttaactaaattctgagcaaatttgtatctacaaaatcactacacatattctcacatcttccacaaagtagcaacaaacttagcactgtgtgccacaccggcaccacacaacctgaaagtgctaagtttgccacacacccccaaagtttgccacaacccaatataaaccaaaagccgccgcacaaaagtgcagcggcctaaataaaaccaaattagcctttgacagctcctgtaagtccatccacgtagaatctctgcatgataacgaaaagtattgagataggtattgatacaataactgcagcagcagcccatcttgtgaaccatccgtttataaactctttctcaagcatgttgtaaaggagaagagatactgtccaatacttgtcgtttggaccaacgataacccttacaaatacgaaatcaagccatggagcaaggaatgctgtaagtactgtatatactacgattggcttactgagtggcaggataaccttgtaaaatacctggaactgtgtacatccgtcaaggatagccgcctcagtaagagacttaggcacagtatcaaagaatccctttgcgatatagaagcctgttcctgctcctgctgagtatatgagaatcaatgaaaggcgaagcatacttccctctgtaagtccgatagcctttaagataaagtatacggcaaccattgacatgaaggctgggaacaatccaagaatcatagccagattcatgaaaggcttacgcatcttaaatctcagtcgtgacatactatacgcaacagaaagtacaaatactgttgaaatgatacatgagatcactgaaataaacagtgtattaaaaaatgctctcgggaagttcaacagtgtagtctctgtgaacagccttgtatagttgctaaatgtaaggccatgtgggaagaagtactttgtataagcaccactctcagctctaaagcttgtcataataatccagaaaattgggaacaaccatactacagcaagtattccaagaatgatatgaacaagggaattctttgctactttcttagcacgtccggcagacataggtttttttgcttttgctacactactcattacatgaatccctcctcatccttgtatgattttgtatttctgtatgtaacaagcgctacgatagaaagtacaatgaatgtgaggataccgataacggcaccgatattgtactcctgattatcaatagtcagcttgtacaaccatgtaaccagaaggtccgtctttcctgcactgtctccgacaggtgtaggctttcctgctgataacaggtagataacgttgaagttgttgatatttccggtaaactgtgtgatgatatatggtcccatgataaacatgatatatgggagtgtgatcttaaagaagatctgtgctgcgtttgcaccatcaatctttgcagcctcataaagctctgaaggcacattctgtaatacacctgtaacctgaagcatggtatacggaatacctacccagcagttgatgagaataacagaaactctcgcccacatagtgttggtccagaatggaagcgggttatcaatccagccccactccaaaagcaggttattaacagcaccctgtggctggaacatctgtctcattacaaggagtgatacgaactgcggtaccgcaattgagataacaaagcatgtacgccagaatgccttgcaatgtgtctctttacgattgataacgatagcaagaaggagtccaaggaagttacaaaggaaggttgcaaatacagcccagcagattgtccatccgagtactctccagaatatcttaccaagcttaccaccaagtccaagcacctgtccgaatgaggcaaagcctgtccagtcgaacaataccagatgatcaccctttactgaatagtttgtaaaggccattggaatcatgaacagcaatggtaaaactgtaaaaataaatattcccataagtgggagaaacataagtgtcttatgtaggtttttatcaaataaatccttgacatctttgccaaaagaattgatttcttttccagcttttgaaaggcattctgccttatatccgctctttaaattctcgcaccacatgtaaataaataatactgtgatggcaattgttatgacgccatataacagtaataatactgactggtcgcctgcaacatattcataaatctgcttctgctcattaaatacctcttcctgttttctccagccaagtgaaggcagcatggaaatgtaataagcaccagcactaaccatatatgctatatatgcaatctctatagcaagaaaaatcagaccctttataatctgcttatgagccatattggcaagacccattacgagtgccgatagcttaactgtagctccgccttttgtgagggcattgccaacagtatacggagtagcaaattccgaaacttttttctttttgtttgctcctatcatacttttcctcctggcatgcattatatatgccattcctttaaactaatttattccaagattccggctacccggaaccttggaatcataatctgatctacttaattatttaagagaatcattaagctgagtattgaagtcctctgtcttctgagctgcattgtcctttgtaatctggccttctgcaccgttctggaaagcatcaccgaatggtgtagctgcatcccagtaacctgccatatcaatgataggctgtgctactgaacaatcagatgaaaccttagccatagctgctgctacaggatctgctgcgatttcctcgtttgttacaagatctttgtttacaggagcctgtgctcttaacttgaagtgagcaagctgtgcatcctcacttccaaggaatgctgcaagcttaactgctacttcctggttcttgcagttagggttaacaccgatagccttagatcctaagaatgcctttaactggcagtcttttccaccaatattgattgtaggaagagctgcaacaccaacgttctcctcaccaagtgcctctttaactgcgtcatagttccagttaccattgaagtaagcgtttactgaaccatccttaagtccagcaagaccaagtgatccctcattgttatccattacgaagtttggatttgcaaataaatctacgatgtagtttgtaactgctactgccttatctccgctgaaatcatatccggcagccttgtctgttccgtctccgaagattgtacatccgtttgctgcatagaatgcattgagataccagccgttatcaaatgggaatgaaaccttaccctttgtaagcattgtatcaaggctctttacatcatcctcagagaaaactctcttgtcatagtacatgaaccatgtgtttgatgtataaggaactgcgtagatgtctccatcatatgtaacagttgctgccatagcctctgagttagatgtcttaacataatctgctgcctctccacctaacttagcaatagcattagccttaattaatggctcaagctgatcgtttgcaaacatgtaaacatcagctgctgccttaggatcctttgtaacaacgtcctttgcatcactctcagatgatgtaacatacttgaactcgatgttgaaatcaggatttgctttagcaaatgcctcgcactctgtcttgagccaagcaccctttgcatcatctaaatcctctgaaggtcccattactgtaatggtctccttaccgccggccttcttgtcggctttctctgttccatttccattgctgcttccgcatcctgcaaacattgttgctaccatagatgcgcaaagtaaagatgctaatactttcttcttcatatcttcctctcctttttgaatataaaatgtaaaaaagtatatatataaattgccgtgcaacttatatcaaattaattatctgcggtaaaccaccgcaatgtttctaatccaggctatcttttcgttgtccaatctgtgtggcttacttgtcatacgccatctccagttatgtccgactgtcgaaggataattcatccttgcctcatttccaagctctaatatatcctgcatctggactatcgccagctctgcggtgctgtgatacagctccctgataagagcatttggaacctgtgatttattttcaatattcagatactcatacatataagcaagctcataatctgtcttgtcactgaatgaaccaactatcgtctcattgtcatgtgtgccaatatatgcaactacatgtgaatcggtataattgtgtggcagatattcgtttgtcggatcaccatcaaaagcgaacatcatgaccttagttcccatccagcccgattttgcaaggagctttttcactcccggtaaaaggcttgctgatgtataatcatcagccactacattaaccccttcaagctcttcgttaattgcattgacaagcctgcgtcccggtcccttgaaccatttcccggataggctcttatcctgtccgtacggtaccgcatatgctttcacaattcctgcgaaatgatcaatcctgacaatatcaaaaagttctctgcatacacgcattcgctttctccaccatgagaagttgtcctccttcatggcatcccagtcatacatcggattgccccacacctgtccgctctctgaatacttatcaggaccggcagctgcaacatactctggtgtatcgtttgcgctcatcataaagagttgtctctctgcccacacatctacactgtcatatcctacatagaatgagatatcgcctattatgtagacaccttttgagttagcataattttttaaatcctcccattgttcgaagaatttatattgacagaacttccaaaaagtaattgtattataattctttttttggtacttttcaagcgcaaccgtttgcggatttctatactcgcttgaccactcgctccaatttttgtataaattgtcggttttcagtgtcataaataatgcatattgctcaagccactccgactgtttttttacaaaatcctgaaactcttgtgcatttgtatcaaatctttcaaacgctttttgtaaaatcctgcatctgttctgatgtaatgctgcataatcaatttctgattcgtctgtgccccagttataccccaggatctcttccttctctaacagcccctcatctaccagcttatctaaatctatgaaatagatattgcccgcacagcctgatgatggttgatatggactatcgccaaatatggtggggccaaccggaagaacctgccagtacttctgtttcaaatcaccaaggagatcaacaaaattgtaagcctctctcccaagagtacctataccatatggtgacggcagactcgagattgaaagaagtattccggagcctctgagattttctctggcctccaaattaccattcctctttcctaaaattttctatttttttcgtatctgagattattttatttcctattgtcagatttgtcaatctttttagtggttttaaactcatttttgccatttttcacgtaatttacattcattttttggtagttattaccacagtttcgaagatttttttcgaaaaatttattacagaaaatattgcctatttctgatagtaaatgtataatttaattatcacataagaaaggacaaatactatggctactattaaggatattgccgcccggctgggcgtgtcaatcagcactgtttcaaagggattaaatggtgccagcgatataagtgaggagcttcgtcagacagttttagacactgctgtcgaaatgggctacagcacaaagcgctccagaaaggtagaaaaccgcaagctggctctgtttattgaaaatatgaactacgagtctatcgatgagttcggatatgatgtagtgcttggtttcaaacagaatgcttttaagcacaaatgggacgtggacatcatccctgtcacacctcagcttcaggcagaagaaaaatatgatacatatatattaaagaatggctattgtggcgcatttctggtaggttttgctcttcacgatgaatggatgcagcagctcaaaaatactacaatgcctaccgttttgtttgataactatatagaaaacaatcccaatgtagcctatgtaggcaccgacagctacgagggcattgacatggctgtaaagcatctgcacaatctgggtcataaaaagattgcctttatcaatggttctcttttttccctggtttcagatcagcgtcaggaagcctttgaaaactctatgcgcgatgccggtcttgaaatctacccggagctcatgggacacggctactatattcctgaaaccgcacagtattacgtttcaaattttattgcagcaggtgccaccgctatcctctgcggaagcgacactattgcaaagggtgttatctccgagtgccagctgcacggcttcaatgtgccaaatgatataagtgtggtaggctttgacgatgtcaagtttgccgcagcccttacccctcctcttaccactatcagacaggagcgtaatgatctgggccgctgtgcatatattatattgaattcgctcattcaccatattccaatcagccgcacacagctacgtccgatgctgattgaaagagaatctactgcacgagtttccaccgcacatgctgctgaggaatagcctgcatatacaccaccttccaaaggagtcaaaattgttcaaacgcaaacatgtaaccactttaattacatattcgctggtatttttcagtgcaatctccatgacagcctgctctttttcggatgtctcttatctatttaagagtcccgcacaaaagcaggctattctgcacaaatcacctgcgttttgggaggataccacaagtgttaaaggaagcagcaatctgtctatcctgcacaatgtcgcctttgaggggcagccgtacaatgatacaagacagtttggtgataacatccttatggtaggacagggcagctacaataattccatcatagagaccgatgatcaatctgttcagtattcatttgatgtatataatccctggtccaatgaaatcacggcaagcctcactcacgacaaaaccgactgtgatgactacatgataaaaggtgaccgactctggctcatcaattccgatgccggcagggcaacaatctatgataaggatttaaaggagataaaaacctgcaaatataatcctgaggactatgatggcaattgcgatacatcagattctgatgatggcgatgtgccgaatcccggcaattattatgatgtctcacagattgccacctccgctgacggaaaatacgctctcgtgtcaggtgtcacacccgatacctacaaatatgcagtctctgatataaggattgacgataacacagtgctttcaacctacgaaggacaaagtttttccatgtcatgtgtcgactcaaagggctttgtaatcgaggcagatacggccaacaatatctggaactatcattcatccgatggagaaaacagctttttttcactgccggatgtggtggatgtgactttggcagaggatggtgacatgctcatacgatgccaggatttatcctcggacaacatcatcagttactataaatattcacccgccaccggtgtcagttcatccttttcatacaatctggcgactcgaaacacaggcaaaatgtccgacagctcatccgactctgcggcagccgataccaagacctactgttctgccaactcggtatatctgcctgatgcaaactgtgtgatgatgcttttgtacacagcgcagtgcaacccggaaattctcatctggtcactcgacaagggcaagaatgacagcaaagccgaaatcacgtcatacaatgactgtgatacactgctacaggccttacgcgatgatggctcatatgtatccccatattctgccatagcccccgctgacagtaccgatgaaaatcaggaagctatggaagaggccgggaaggattccgactacaatacatacggcgacgaggtcactctgatacctgacaccgcgtcatatgactggggtgatttatccgacataaatgcacgtatcacagcccttgaacagaaatacggcttttccatatatttcgggcctgaggtgccaaagagaattgattactacgatatccatcaattcaagaacaaggataagctgtcgattgctctggattcgcttgaggaaatacttgactgtttccctgatgactttttcacacagctgtgttatggcgatataagaggcatgcgaatctatctgtgcggtgatatttcatcaggccactcagatatgataaatgagccaagtggattcgtaaatataataaacaaccacaatgtaatagttctaaactgcaactacagctgggatttcagctacactgtaggccatgagatttcccatctgattgaccagaggcttacattcatacacacctacaatgacaagagcgagttttctgagaggaaatggaacagctttaaccctgacagcttctcttatgatgatagctacgcaaactacaatccggatgatccatcgaatcacatatccgggtatttcattgattcctacggcatgacctttgcaacagaggaccgctctgaaatattcggaaccgcgatagatgattatattaacggcatctatgatgatgcaagattcacagatgattcgccgatacgaaacaagctggactactacagcagatgtatccgtgatggctttgatacaaaggactggcctgatacgatggcatgggagtctgtgcttaccgacaccgggacgcaggccgattaaatgataatttcagaataacacaaaaacctcaagtcatacgacttgaggttttttaatgggcagagatggattcgaaccatcgaagcaagttgcagcagatttacagtctgtcccctttggccactcgggaatctgcccatgtattcaattacgatacttgcatagtttatcacaatagatgtgattatgcaagcatattttatcgtaaccaaattattttctttaatacgtggattgcgcgcctgggacgatactttggtgggggattgatgccctcgctttcgctacgctacgctgctaagagtctgtaggaattatgcttttaatctttctatgacagacgaaaccggcttttatgcgccgtccatggcgcataacgccttgcccagccgtccatggccgggcatttctgctcctctaagcataattctgacagactctaagcaacttctctatgcgctccagtaagggcatcaatcccccaccaaagcaccatcccgggcacacaatcccttactttgtagctataatatagaaattaaaaaagacagcctgcgatcggctgccttttaggagaaggtatttttactatggggtatagcaaaaactatataatgtattggggggtttttacggttattataatatcacggttataacgataagtgttcacaaattgcataaaaatcgtagtttgtttttatgcaatttgtatactactttagttatatttaatatttttcatatagtgattctgcacaaaagtatagttattttttaaatattatgtccaactgttgttttgctgtcctcgtcaaacagtgcttcaaactcatctcttgtgattttctccttctcaagaagaagtgctgcacatctgtcaagcacatcgcggtactctgctatcatgctctttgccttgtcgtacgactcgtcgatgatacgctttacctcgacatcgattgccgatgctatgccctcgctgtagttctttgcatgggcgaggtctcgtccgatgaagacctcctcctcatcatcagcatagcagataaggccgatattgtctgacataccgtatttggtaaccatctcgcgcgcaagctttgtagcctgcttgatgtcctgtgatgcacctgttgtgatatcgtcaaacacaagctcctctgcgacacgaccgcctaagtctactacgatttcctgaagcatacgtccctttgtgttgaacatctcatccttctcaggcagaggcatggtgtagcctgctgcgcctgctcctgtagggatgattgaaactgtgtatacaggtcccacatctggaagcagatggaaaaggattgcatgtcctgcctcgtggtaggctgtgatgcgcttttccttgtcagagatgatacggctcttcttctcagctccgataccaaccttgacgaaggattttctgatatcatcctgtgtgatatattctctgttttcgcccgctgcacggattgctgcctcattcatcagattctcaaggtctgcacctgtgaagcctgcggtagtctgtgcaatctgctttaagtctacatcctctgcaagaggttttttcttggcatggacacctaaaatttcttctctgccgcccacatccggtctgcctactacaacctttctgtcgaaacgtcccggacgcatgatagcagggtcaagtatatccacacggtttgtggctgccatgacgataatgccctcattgacaccaaagccatccatctcgacaagcatctggttcaatgtctgctcacgctcgtcgtgtccgccgcccattcctgtgccacggcgtctggctactgcatcaatctcatcgataaatacgatacaaggcgcatttttcttggcatcctcaaacaaatctctcactcgtgaggctccgactccgacgaacatctccacgaaatcagatcctgaaatggtgaaaaacggtacccctgcctctccggctactgccttggcaaggagagtcttacctgttcccggaggtcctacaagaaggacaccctttgggattcttgctccaagtctggtgtattttcccggatcacgaaggaaatcaactatctctgcaatctcctccttttcctcctttaggcctgctacatcggaaaacttgatatggttctcctcctgtgtagtgagcttcgcacggttcttgccgaagttcatcatcttgccaccgccgccctgtgctgctgcgttgttgttcatcactgcaaagagtatgaacatggctccgaataccagaagatacggaagcagtgtcataatccagctctcagccggaacatccgcaactgtatagtcggtgtaccctgcttttgtcatggtcttttcgatattgtttacatctgatacataaagcacctttgatgtgccatccttgaacttcacctccagacttcctgtcggtatctccctgttttgcactacctttacgctcttcacctgattcttgtcaagatccttctcgaactgactctgtgtgtaagagtttgatgtagccccggcgctcagccagtaccagatgcagattactgcaaatacaatgataatgtatacgcctattccgcgcataccgcttttttgtttattcaatttacttctcctttttattttatttcgccctcgacgaagccgatgtaaggcagatttctgaacctctgatcatagtcaaggccatagcctaccacaaacttatcaggaatcacaaagcccacgtagtctacatttacatcatcaaccacacggcgctcaggcttgtccaaaagtgtacagattgtgagactcttcgggtttcttttggcaaggagctttgaaagcctgctaagagtatttcccgaatcaatgatatcttctatgatgatgacattctctccctcgatagaatgctcaaggtcctttttaatcttgacatcgcctgatgactctgtgcctgagccatagctggataccgacatgaaatccatagtcataggcaaatcaattctctttgcaagctcagtggtaaagaatattgagcccttgagtatgcaaatgagatatactgactgtcccctgtatttttctgtgatttgcgctccaatctctgcaatacgcttattgagctgctcctctgtcagataaaccgaaatatcatatttctttgaaaaatccattttgttttcctccgtaaaatgtgatcttaagtacttttcctgtctgttgtgtgacaagtgcgccacagccggatctgtatccgataatggcatgcaccagtgattcatgggctatgagccacagccccgctctctgctgtgcaggaattttatcacctgtaaatacctgcttcagcttcttatgatggccctcgtcatccacaattatatagtcaccggcttttcttgttcttatttcaaagcctttcttcatcttatcataatcaaaccatttcgtatatggttttttgggaatttcgtccattttaccattaaaatcttgtatacaaagtgtgacatacgagccatctgccgaaagctttatgtttttttgctctcccgtggcactcagtgcctcaagctctttttgcgtaatgtgaatttcttctttttcatcgtcacaccttccggcgaagagtatcacctcgccaaatgatttttccgcaataattccatatggcagattgatttttctgcccgactgctgccctgcaagcttcacaagtgcaccgatatgcatgctcgtgatgtccttgagccgtcctgacgccagatgtatacactcgcgcgccactccgctttttaatgccggatgcagactctcaaagcgactgatttcaagtatcaccctgccttctttttttgaaaccatgctgtcacacgcctcttttagctgctcctcgtaaaaatcattcatcaccgcaagctgtcctgcgctctcattgatatgctctatcgccctgtcattaatctgcaaaagcaaaggaaacacatcatggcgcagcttgtttctggagtaggctgtgtcagtgtttgtggcatcggtgacaaaagcctgtccgttttccttcagatattcctctatctgtgcgcgtgttgctgataaaagcggcctgatataggtgacaccgttcttcacagaaaccggatgcatgccggatagccccttcgctccgcttccgcgaagcatctgaaaaagaactgtctctgcgttgtcctccatatggtgcgcaactgcaacgattacctgcctgctgttaccctgcttttggtctgctgcataggcagttttgcaaggatatctgcctgcctcctcttcaaacgcctcatagcgcaatatcctggcggcctcctccagcccgagtccatgacttgctgcatattgcggcacatccacggaatgcacatggcacggtatgtgaagcctctcgcagagatctgacgcaaatctcgcatcctccctgctctcggctcctctgatgccatgctccacatgtactgcctccagcgcaaaatcaagctcatctgcgcactgtctttttatctcatttaacaccagcagaaggcagacggaatccgcaccgcccgacagcgcaacaagcaccgtgctgtgattttttatcattttgttttccagaatataatcttttgtccgtctaatcattatttttcccagattcctattgcaactaccgtcatatcatccatggcgtatccgcctgtgtcaagcagcaccctgtccagaatttcctgcgccatcacgcctgcattgtcacttttgacgcctgcgatgatatccataagtttcccctgtctgtcctttacatgcagatattctagcacaccatccgtcaccatgacaaggaaatcgccactttgaagtgtattttttgattgtttactctcctgccagacatcgacccccgccgggagtgattcattttctataacacttacttgtttccctgatttgataaatgacggtgcagcgcctgttttggtaagctcaagctcacctgtgtacatgtctatcgtagcaaaatcaaccgtggaataggactcctcgcccgccgatatgaccatggcagagttcatcagctttagggcactttccctgctaaagccggcctccaaaagcttttcaagcaaatccaccaccagcgtgctctcggcctgcgcctgcttgcccgagcccatgccatcggatacacatacatgatacatgccatcatccagctgaaacatgctgcaactgtcgccatttgcctgagagccggtcttctttttggtcgccacccccgaaagtgcatagaactgattctcctcgtaaagcacaatagatgtcctctcatcggatattattgaaactgtcccatgtgcctgcctgagcttcactcccatggcgcgtgaaaccgcctgcacatattttgaaatttcaatcccaccatctatcttggtgcagacatctgcctttatacatacctgctgccttgcgttctcataaatatgggcattttccacctgtataccagcctcttttgtatatacataaactcttgaaagacgcagccttctttttttatcaatacatttttcagccctgcaccagctatccatgagctctgccatagcgtcaagctgtgcggctatgacgcgtctgttttctgtaagacgcctgtaccaggcttcatttagctcaatacgggcaaatgcctctgtggcggcttccaccatgcgcgtatagtgcgggcagccatccacatatctgttttgcacaatttcctctgttttcatacgtttgcgcactgcatcagcaagcatttttatactgtcggaaatcgaagccccgcttgtccagcacacactgcagccctcacagcatgcacaaagtctccctgtcacctcaagctgtattttctcactctcatcagggattttatctgccgtacattttacagtcatgacatttgcagtcgaaataatgcctgaaagtcctgaaactgctgtggcaaatgcctcctccctgtcgggcagaagccctgctatgaccgggttttcattgtgctcaagggcccttaaatattcgcatgctctgcaaagcacaaaggccatcgaaaacacaacaaggctctctgctaccgacaacactatctcatccgtatccggccttcccagaaatgttaccgacagattcatcaccgccgtggcacaagctgctacaacggctgttgtcagacatccgtttttactgctttttctcacaaatagcctttccccaaagtaaatcaccgcaataataaagagatacttacatatcgacggtatcgatataaagtatcccattccaataattaatcctatgtaaaaaataatcgtatgtccactgctcagacaataaactccatacactgcaggtatcagcggataacaatccatcacacacaccagtgtggatgcaaatgccataagcccccacacagccttttttaaatttgcactcctcatctttttgcctccatcttttttcaacgattatatgtggtcaaaaatgaaggttttgacgaaaaagcgcaactatatcttcaaaaattatttgtccttttccttgaagattatttcattgtcatacgcaagccccagcttgctctttgctatatcctctatgtactggtcactctgcatatactgctgcatgctttctatctcatcagcacgctccgattctttagtgtactgcttttcaagctccgctttttgtgcggcatatgtagattccttctgctttagctgcacaacctggactaccataaccacaagaaatgctataactatgatggaaacacttaaagttccgccccttctctttgcacgacgtttactcattattcctccttaggtgcttatctgaatatcctgccaaacattttatctttctttccggtcacctccggtaccttcgaatacgtaatcatgtctatctcaccttctatatcggcttctcccttctcaaggtttagcctgtttacgtgaagatccttgccctttaggtcaagcatgcccagctccgtctccaaaagtatctctcccacatcaaaggagagcacatccaaaatgcctgtaaagctgcctgttctgcgattattcaagataagcttatgactctttgtgcctgatatttcttccatttcctgtccctcacatattttttatatgtcccaaaaacagcctcacatatggctgccatctgtggaatcacatatgtaaatatatgccgggatttatgaaaatataacctatatatactcaaaaagatcttttgcttcttccttctttgttgtgtcaaggagatttaacaccttaaccttgactgtcttttgtccaaatgctatctctattatgtctccgaccttgacatttacagatgcctttgccggtctgccgtttactgtgacacggcctgcgtcgcatgcctcatttgccactgtacgtctctttatcagacgcgataccttcaaaaatttgtctaatctcattgttacctctgtgtcttacctataataaatcaattcataaccattaccctgatttcagtggatatagccaaaaatgggcggagccttaaaggcttcacccattcttctactccgtgatagtctaacttattagttaagagaatcttttaaagcctttccagccttgaacttaggagccttagatgctgcaattgtcatctcagcgccagtctgtggatttcttcctgttcttgctgctctctcagatacctcgaaagtaccgaatccaactaactggatcttctcacctttctttaactcctctgcaacaacatctgtgaatgcctttaaagatgcctctgcatccttctttgatactccggccttctctgccatagctgcaactaaatctgctttgttcatgataaaattcctcctctggattttcataatttatataattcgagctgtattcccaaattacctacaagaatatatatacttgtttttatggggtttgtcaaggaaaatgcgctatttcctaggcttttatgtacttttaccattcttaaaaccttactttgaacttaataaagaggttaatgttgaaagataatcggatatgtccttatttgtcagactatttttggaactgtcagaggatttattgttggttccccgtgatgaatttgtactctgcgagctgccggtggtgctgccctgagatgtactttgattgtccttctcatcagccctctctgaggctgtctcggaaggtgtctgtgcggtggcttgtgaactgccggtgctgttagttttggtacctgatgaatcgtttgcagagctgtccgtatcgtcatttatcgtaatctgtatggtggcctcctttgagttcacgtaaagcgtcctcgtccaggtgtcatagccatcggctgttaccttaagcgtgtgttttccgtatgttatctcaaccgggctcgtatagtcgatttcactgccatcgacatatatttttgctccctgcacgtcaacctcgaaaaggatgctgctctttttaggaccctcaccctttaaatcatttaaatttacctttgtagtctcgcctctttttatctcaatatccgtgctgcctccccagccgttgttggccacagcgagcgtatagctgccctccggcacatcaagcgacatatccttagtgatttctgcaaatatcctgtctccgagctgcaaaaagctgccctcaaacagcgatgtattgctaagctgcagtgtgccgtgccctgtcgtgacagaaatcgacactatatccttgtcaatcccgacaacagccagcttatcctgcgccgtgaggctgtcagtatctatgacatccgagcctgaaaatatcatggtgcgctcacccagcctgtagctgctatttccgatttcaagcacgctcttattcttatccacagaaaaattggtcactgcgtcgtttgtccacaccttatcggatttttgtatccgctttgccttgccgtctgaatctgcccctgatatgtcaaccacatcaccctgatgtatgtctgaaactgacatgtgattgccatatttgtcaaaaaagccggtggtcagcccatagtaatactgatactgcactcccgtcgagtaattgtataccctgattgtctcattggcactgtttatgtccgatactatgagaatatctgaacttttcttaacggactttccgttttcctccgcagcagctttcaaaccggactgcgtgctttctcccacggcctccgtcgtatcattcatgctgttatagaatttttttacaccatcatccgtgtcctgttttccacatgctgcaagtgacagcacaagcatgcatactatgcaaaataatcttttaaatttcttcatctgtatttcctttaatagcttgctttaaacgtttttctacaataataatatatcgtatagtcatttacttttcaattaaattcactatatatatgcattacagcttacactatggcatgcagggcatgcagatactcctcgcgctccccgcttagctgtatgagctgtgcaagcttatccacatcacggtcgcatacccatgacttgcgcgagttgctatagtgattgcagagcttacaaaatttttcaggaaacaaaagcagtgcttgaagcagtctcattgatgtatcatcaagacttcttacgctgcaatagctgtcaagaattgcatctgcaaccgctgtatcccagtgatttttttcgagcatcttgcgcatatactccgcaagatcagtttccggatatcccggatgcatggtctcgaaattgacaggaagccatcttccggactgtgtatacacgacattgtgctggttgaaggctccgtgacagtatatcggaaccgacgttttactattttccagctcacacaatatttccgccgatttctgcccctgctctaagaatctctcatagcattcataaaacagatgctcaaaagcatttgtcttgctgcgacgcagtatgtagtttttaagctttactatctgcgcacatttgcgctgagctttttcatgcaggctttctacctcgatatccgaaggcagcggatacttttccaatatattgtgcagctgcgctaatgccctgctgccgccacgcatatcatctatgctgtccgtgctgcactctctgcctgctctgtaatccttcaatatgtatgcgtcctcacagttatcccgcgatatgatacactgctcctttgtctgtgatatctgctccacatccataccgtttctctggataaatgccagcgtatcccgcagggtgcatgccctttgctcatgccctctgtacggcacgagcagcttctgcccgatgcctgtgtcacatatatatgctcctctgccctttattatcctgcttactgtaagctcatatttttccaaagccacttccggctgattatacaaaaaaatcccccctcatatgattaatacaccataactattcagatgctttttaatcatatgagagaggttattattttattcgcaagctctttaagtttttgtgcttcattgagcgatgggtcatcaagcacctgctcataaagtctgtccaggatatcgccaagcttcggtccaggctctactcccattttaatcaggtcgctgccatttattttcatttccttttttgatacacactggtggtctgcgaggattttcctgtatacacgctcatattctgcgatgtattcaagcttttctgcgcgcttatacatgctctgtccgagtgtatcggctcttttcacctcaaacaacagcggaaaaagctctgttcctatgcggctcatggcacgccttacattgcgctccgtgatggccggacggtcatcatgctcttttacgagcttacagcagcagtctgtagtcctgttatcaaacttaaggcgcctgagtatctttcttgtcatatcagctcccacaacaggatgcttcttgaaatgattctggccttcctcgtctgtcgtaatgcacacaggctttgccacatcatgaagcagcatggtaagccttaggattttgtccgctcgcacatgctccaaggtatgaagcgtatgctcgccgacactgtacatatggtgcttattgtgctgaggtgtctgcatcatcacatcaaactccggcatgaataccgctgtgagtccaagctcatacagatctctcatcatctgcggatgatctgatgtcagaagcttcacaagctccacctggattcgctctgcgctgacctttgacaaggcaggggcaagctcttttatggctgctttagtctgtgcctctatatcaaagccaagctgggctgcaaatcgcaccgcacgaaacatcctgagtgcatcctcactgaacctgtcgtgcgcacagcccacacatctgatcacatgtgcttttaaatctcctatgccgtcaaattcatcgacaagccctgccctgtgattatacgccatagcattgattgtgaagtcgcgtcgctccagatcaagcttcagattggaggtaaaggtaacctcctttggatggcgtgcatcctcgtactctccgtctatcctgtaggtggtgacctcatagcccacatgctccagcatgaccgtgactgtaccatgctggatacctgtgtctatcgtatggtcaaatatcgctttgacctgcgcaggctttgcagatgtggtgatatcccagtcctgcggtgtcctgccaaggagactgtcacgcacgcatccacctaccgcatatgcctcaaagccatgctcgtagagcgtgtctattatgaagttgacattctgcggtaaatctatgcgcatcgttggattctccttttaatatgccttgccccagtatacgagcttatgcgccggctttccacagcatacgcatacgtcggaaatctgctcctggtcaccaaatggcatacaacggcttgtaactgttgtgtcctctttgattttgttctcgcaggcctcgtctccacaccacattgcacggataaagccaggctttgtctctgcgattgccttgaactcattgtagtcgtgtgcatcgtttatatggcttgcaaggaatgcctttgccttctcgagcatgtcattctgcattgtctcaagtacctctgcgagcttctcatttacctcatcgagtgagacaacgattttctctcttgtgtctcggcggacgataacgcactggtttttctcgatatcctttggtccaatctcgatacgtgttgagattccctgaacctcctgtgctgcgaacttccagccaggtgtcttgtcggttgcatcaattttcacacggaaatcctttgagagcttgtccttgaggtcgtatgccttgtcaaggacgccgtccttctgctgctggattggaatgaccataacctgtgttggtgcaatctttggtggaagcacgagtcctgagtcatctccgtgaaccatgatgatagctccgataagacgtgttgaaacgccccatgatgtctcatgacagtactgtaatttattgtccttgtctgtgtactggatgccgaaggccttagggaagccgtcaccaaagttgtgtgaggttcctgactggagtgcttttccgtcatgcatgagagcctctattgtgtatgtagcctctgctccggcgaacttctccttgtctgtctttcttccctttaccatagggattgcaagatatttctcacagaaatccgcatagatgtttaacatctgtactgtacgtgcctctgcctcctcggctgttgcatgaacagtatgtccctcctgccataagaactctgatgagcggaggaatggacgtgttgtcttctcccagcgcactactgagcaccactggttatatacctttggaaggtctctgtgtgactgtactgttttgctgaaaagctcgcagaaaagtgtctctgatgtaggtcttactgcaagtctctcctgaagtgtctcaagtccgccctgtgtgacccatgcgacctccggtgcaaagccctctacgtgatccttttccttctggagcaggctctccggaatgaacattggcatgtatacattctctactcctgtctctttgaacattgcatcgagattcttctgtatattctcccagatggcataaccattgggtttaaagatcatgcatccctttacagatgaataatccatcaactctgctttcttcacaacgtctgtataccattgtgtgaaatcttcctccatggaagtgatggcctctactaattttttctccttagccattgcttttctccttttttatttaaatattctatgatatacgaggcttttatatctcatccggcccctgcaccacgcataattttactaacatatattattccataagcgagctgatgtcaataagcctgaaaacttgttctgcagtgtttttcatatttttttgagcatttttgatatccatagcctcattaagcgttgttgcccctcttataatagggaaaaacgcatctatgccttctttattacatgccactgcatcgtcagtgacactccctgctagtgcgattactttacagccgttttttctgcctgcttttgccactccgacaggcacctttcccatggcgctctgtccatcaagcctgccctctccggtcactacgatatcggcatttttcagttccttgtcaagctgtattgcgtttagcactatatctatgccggatttaagttccacgttctcaagtccaaaaagaaacgcaaagccaagacctcccgcagcgcctgctcccggtgtctcgctgaatctttttcccgcatactcctcaacacagtctgcatactgtctcatcattttatccatctgtgccttttcatgctcctgtacgcccttttgctttccaaaaatgtatacgcagccctgctctgtgcacagtggattagtaacatcacatactattttgaaatgacactgcttcaattccgaaggaaccttatcagccttgatctttcttacccttgcaagcgagccaaataccggtggaagaatattgtcatcctcatcataaaactcatagccgagcgccgtcagcattcctatgccaccctcagtggttgcgcttccgcctattccgattatgaaattccgacagcccttgtgcacggcatccagtatcatctctcccacacccaatgaggttgctttccacggatcaggtttaccttcaacaagtgtgattcccgacgcttctgccatttccataacagccgtatcatcctcaagtactccatatgtcgcgtgtaccttttgtcccattggtcctgttacatcaacatgttcatatgtgccattcatgccctctaccaaagcggttacagttccctcgccaccatctgcaagtggtctgaccaccacatctgctttcggtattgccgccaatatgccttctttacatgccatcccggcctgcatgcttgtcatgcttcctttaaatgaatcaattgctactacaaccttcatttaaccattcctctattttttcttaatatttattcatctttcttattcagatcaattatgttcatttttcttaaaatcgactctttaattgctccacttaaatatgccggatttaatttacgttttgcatatgccaaataggtgtcttttgtttgttcaatcagaatagctgtaaaaaacctttcccaactgaaataaagcttgctctctacatactctgatggattactcaatatgcttcttactgtattattctttaaaatatcggcatccataatcatccattcaaatgattcaggcaaatataaggccacattttttctgccatggataacctgcaacaccctgtcaatctcggaaccaaatgccgccccatctgcaatgacaagtattttttcacctttatgtttgttcagataatgaaagacatttgattttccattcatagattcacatttcaaaccattttctatacatacatgttcaaaaaattgatatcctgaattgctgtcttccgtaataataatttccggactcactttatcttcatatgtatctgttccatatatccgatagaattcatgataactttgtttcaatgtcccatatcttccagatgtacgaattccatagatttcttctacgctatatggcaatgctggtaaagcttccctagtaacaattacataataattatctgttttttgaattttatctgcaaaatctactgtcgttatgaattcatttccctcatcaataaatacaatacagtctgatatgcctgacaactgctctttccataaacttccttcaaccacatgacattttttatcacatatcacctctacaggtgtgccggttggattattcacgaaatcacgaatcatatctacaagtgtagtttttccagttgcactgtctccctggataatcgtcagatttctccgaagttcaaattcatactttaaacgttttgttgatacaataactttatgttttcctttcatcgtatcctcctgccatcaaacaaattcacctgcaattgataccagttcttccatggtatgtacaatttcattcgtgttaaggattcggatgtcaaacggttcaacttcaaatttcatcaaatgacgtaagtttattgttctgtcttctgtttctgcaatttttaataaccattttgcacaattatctccacaggtcgatgcattgaaaattttatttttttcaaacttcaccaaaatcaatgttttaacaccacctgataaccccgtaggcggtatttttcctaacactgggctgtcgattactccactgtccaaaacaatcgactgatccacatcctttatcattttcttcacaaatggatctgtaatccagttatcttcataatcatatttaaaatacgctgccgtattatatactgcttctttcatatctccataaaatatattcagcatacaaaatctactcctcctgttagattagccttgaatgaatttcacctcactacaatacaaatgtattttccaaaacctaggtaagtgcttaccatatgaacctccacgaaatccatcaatccgctgtacttagctacagtatagcggattgatgggcaaattacaattattattaccggtctttatgcagttacatgatgcgcaactgcaagattgtaaagtggtacaaacaatttgaaagtgcattttcatgaaatttgtgctagaataacatgttgttgtaatatgctaaggagaatttagaatgaaaaactataaacgaggactgacagcgggaatcccgattgcgctgggatatctgtcagtttcatttacttttggaattatggcggtgtcatatggactatcctggtggcaggctgtgctcatttcgatgaccactgtcacatctgccggacagtttgcaggcattggaattatgatgcatccgggacagtatttccagatgcttatttcgcagattactattaatataagatattcctttatgtcgatttcggttggtcagaaggcggattccagatttagcggaatttccagatggatactcggctttatgatgactgatgaaatttttgccgtggcaagccaggaggattctgtgagtagaagcttttttgcaggactttcaactcttccatacatcggctgggctgtcggtacgctgataggtgctatactgggaagcattctgccggataggcttatgagtgcgctgagtcttgctatttatggcatgtttgtggctatcgtggttcctgagatgaagaaatcgcgtgcggtcgtgtttgttgtgctgcttgcactcgtgcttagctgcatgttttactacgtaccgtttttgtcaaggatttcaagcggtatcaccatcactgttgtagccattgtggctgcagttatcggttcgctgctgtttccggttgcagatgatactgataaggaatgatttattaaatatttgataataagcgtataaggagattttacataatgaaaaacagtgtattttttatatatttactcatactcgcgggctccacatatctgatccgcgttattccttttatcgcaataaaagaaaagatcagcaatagcttcgtgcgatcttttctatactatattccgtatgcagttttaaccgccatgactattccggcagtgttttatgctactaactggtgggttggtgcagcagcaggacttatcgcggcagtgatatttgcattaaagggcaaggggcttacaaccgtcgccgtggcttcctgtgtggcggtatttattgtagagctgttccactaattatttattttcccacttaaaagattccatcaataccatatccgaaatgatggaatctttatttttaatttactttctcctgtctatgccactgtcactgtaatagcgtgccttgcttgcatacattctcctgtctgcttccttctcaatatcgtgtacaagctcccagtcttcctccagacttcttacacatccgtatgagatggtcatggaattgacgatttttcctctccattcggctacactgctgtcgaaatgctttgtcatagtatcaagctcatccggcttttgagtgactatcacaacaaactcatctccgcctattctgtataccttgccaaactcaccaaagcttgccatcatgcaggctgcggctgcgcaaatcatctcatctcccacatcatgtccatatgtatcgtttatgtgctttaaactgtttaaatcaagtgatatatatatccactcttttttcaaatcaagcttattgatatctgtctcataggcatgtctgttcaggcaccctgtaagtgcatcagtattcgatacatacagcagcttttctttctcatatttttccttcataatcttcgaaaacatatacataatacagcacgatgctagtataagatatatgccaactacaagcagtgctactacgctgttcgtcatataaaaggatttgtcaatggtgacagccactatatatttgtcacctctcctgattacacatctgcagcctgaatcatttacgctaatctgccttactgtgggcttatcgctttccttaatatctgttggaaggcctaaatcgtggaagttttttcctattttgtcacaatctgtggcccccttaaccagttctgtatctgcatctgccacatatagttccatgcccttgtacacaggcatgtcagaaaccactgtagatatttcattctgcttcaattcatctaagagcctttgcggcttcaagcccacctgtaccatcattgtgccagcctcattccaggtaatggcatacatcattgcctttccctctgatgtattcggtgtgacatcctgacacatcgtaaggctcttatcggtgagcattggtttaaaatatgacatctgagtccccgaatcaaagctgtagccaaagtattttggcacgctgccgctggttatacaacctgtttcatcaaacagatgtatctcatctaccgacatcagctttgctatcttttgcaattcctccacatcattttctacctgtggctttgcatctacgatatatgacactgcctttgccctgactatataatcgtcctttaacgattctataagttcctcctcactctggtcgtttttattgagcacagtgacaacacgatccagaagcacctttgatagcctatatgcatttgcatcatttacatatttcaaaattcccgcctcgagaagcagtgctactacgattactgcaactgagaccattgcaaatcttcgcttatttttcatatccaaattataccaaatatatgctgattacgctatatttttctataaaattacggaccgcaggtcaccgcctgccggggcatcgcacatactccccgtaagctacgctgcgcggctaagattctgtacgaaattatgcttgaagggtttctatgcttgacgaaaccgtcgaaacgcgccatccgtggcgcggttctcctcgcccctgcatccatgcaggagcgtttctgtgtttcatggcataatttctacagtatctaagccgcttcgctattcgcttgcggggagtatgtgcgatgccccggcaggcggtgacctgcggtccttactctttgctaaaacccaggtactttattgtggtttcggtatctgacagtcaacatacaggatatggtttatcagccagtctgtgagatatttaaggattcccataatctgctcatcctgatctatctcctcatcactgtgatgctcaatgaactcatccagcttttgtacaaattccatatgctgaaccttctgtgtaaacatcttcttgtaatgaattgattccatgtactgctcctcgtcagcaaagtgctttaccgtgtagtcgcgcagcttctccaagatgatatccatcttatcatatttatccggtgtaaactcatcatgcagcagttcatatgcctcatctgcatatttaaataactgcttgtgctcttcatcaatcatatctattccgatataatattctggtttcatttcatacataatttcatccttctttcttatgtagtaatatataaactttatgttttatcattagcaacactttaacatttcaaccaaaatgacttatgatgtataacgtaaacaggttgctgggcgactatttcaagcgccagaaccataaaatatggtactgccggtcacatcgcagtgtggccggtgataaccggacagtcattaatttatggattttatatgcttccggttgtagatcagatgcagatacatcgcatcgtgggcacggacggcatcgtgggctgcaattgcatctgcaatttcacgatgagtttcgatggtttcatcccgcagggtgtattctttagaatcactgatcagaggaattgaactgttgatgataggaaccagctttggaacaactatatttttgctgcttaaggcaatagcagtatgaaatgctctatccttttcagcgtgatttttatttgcaagaaggagcttttcggtattttcacatgcagtaagtatgtttttgatatctgtctcatctgcacggatagcggccatggcagctatggatggttcgattagaaatctgatttccatcagatctttaatcatcttttgtttatcttcaacaaaggtcaggccgaatggatcatcaatcatcccgggagtggcggaaacatatgaaccggagccttggcgtatggtgattacattacgtgatgcgagtgctcgcatagcttcacgcagagagcttcttccaacattcagccgttcacacattacggtttcgttcggaagcttgtcacccggctgcagattttcctccagtatgtatttgataattctctctgcaatcctttgggaaagagttttttctttggaattttgcatgtgacttgcctcctgttgcccaataccttgatgtttagtttttctgtacgtttaaatattctttcaaatatttcattggcattctttttgtctgtaactcccggaaaatattccttatatcccatagttgtttaaaaacacgcctttttcgcatggtctgccatacagatatccctgcatataatctacatggatttctttcattgcgcaagcccactcttccttctcaattccctcaatgcagatttttatatttacactgtgaaccatctctataatctttctgaacagctcatggtccttttcactgcgcatcgccattgccgtaaaatccttatctatctttacatagtccgggttcatctcactgatatagcgaagatttgaatagcctgttccaaaatcatctattatgaactggatattattctcatcaagctttttcctgaagctgcaaaaacatggcgtcatatccatgaatccactctctgtcatttcgatacagatggattcaggtctcagattgtttgcccggatagcagtaaggattttatttgccatacttccacgcataatctgtatatatgatacattgatatttaccctgaaatccgcaatatactgctgcatttcacggcacatttttgctgcttcgttcaatacaaactctccaaccggaatgataagcctgctctcctccagtaaaggaataaactcaaccggggagatcatttcatcgccctcatccgaatgcatgaaaaaccgtaaaagtgcctctgcaccgattattcgatcagcactatctaagataggctgataatatacctcaaagccttcaaaatcatttacagttgcgctacgaagcgcactcaggatggtatttttgcgcaatgacactttataatcctctgcctcaaagaaataaatgcttcctccgcctcttttttttgcgcattttaaagaaaaatccgactttttcctgcactctattgcgccctctgccagtgttgatatatctgtcactccggcagaaaccgaaaagattgatttatagttttcatcaactataaactcatcaattttttcacctatccttttgaacaactgcaccacttcatcctgcgatttgctcaacatatccacaagcatatacttgtctgtaacaagatgatatattttctgaccgcttgagagacattctgctatgcattcagccactcttttaagtatgtagttgccatatatctgtccatgaatattattgattatctcaaaatcgtcaattccaatctgtatgaaataacctgacagcttctctttaggctgtgaatagagatatgacgccatctccttttcacctaacagcccactgatattgtcagccctctgcctgtttcctgtctcattcatacagccgataatatagtgcggttttccctcattatcattgattacctccccacggcagctaatccataccggtaaattcttcccgctaatcaaacgacatagcacgttgtaccttttttcttttccatcatatattttacgcttgtgattttcgagcagcttacggtctttctcataaaccaatgtacgaagatgctttgttgcatcattcataaatttatcaggaagcataaaacgctctaccgctgactgtgatatcctcagtgtatcattctttaaatctataatatacagataatcatccatacaaggtgcaattaagtctatcagacttcctgcctcctgctcgtcaagtattttatatgcatcaaaagccctcattaaatttcaccttctattatattactcttcaatgtctgagattttgaattttgctatcatttcactcagattttctgattcactgctcatctgctggctcgcagccgcacactcctgtgatgttgctgaattggtctgtacaacatcattgatctgctcaattccttcgttaatctgcttgatctcactggtctgggtctccagtgtatcagctatattagtcacctcttttgtaatcaccttagagttctctgctacttcttcaagctgtgaagctgtctgctctgcaatattcatgcctttttcaacagcctgcacagatgtctctataagcgcagctgattcctttgcagcctgtgcactttgatcggcaagcatatttacctgatttgccacaaccgcaaagccttttcctgcctcccctgctcttgctgcctcaatagaagcgtttaatgcaagcaggttggtctgtgatgcaatctcattaatggttgatataatctgatctatctgtttagaggcttcgtttatttcatgcatagatgtaaccatctcctgcatctttccattgctttcccaaattgcacctccaagctcatccactcttccactgatttcctttgcactctttgaattctgctccacctgctctgaaactccctcaaccgtcgctgtcagttcctctacaaccgcagcctgattggttgcaccgtctgcaaggtcatttgagcttgcagctacctgctctgccgcacttgaaacctcgcttgatacattctggattccctttatggtgactgccatacttttttcaaattccataaatgaatgtaaaatacctacaaaatcgcctctccactctacttccggctgtgcatcaaaatgtccgtccgcaaagagcttcatcgacctgtctatatcatccacatatgagccgagaatacggatagactttctcatgctgtgtgccaatctaccgatttcatcctctgaacggtaatcaagtgtgctgtgaagatttccttctgtcagctcctttgccacttcctcgattgcatgtaatggctcaaggattgtatcaagcacgatctttcctgttctctttgtcaactgccatgcacatatcagacagataatgatgactatgagtccgactgcagcacatacatatgtccttacaactgcctgatggcttctttcgtcagtcagcttgttgatttcctttgcaagctcaactgttttatttaactttggtgtacactcattgataatctgatcaacagcctcatccttctgtccggctttaatcttatccatgattgagtatccgatattcgcccagtcagaaagagcctttgaatattcattatactgatcctcaggaacgatacctgatttttttattgtttttaactgcacatcaacatcttcaagcttttcttttgcgccctgctcatagtcgtcatatgttgatttgtcaggattaagtgccatctctcttacatttctagccgctgcatttacatttattctacatgtcttaaccgcctgatcggcagcatttaccttgtttacatagtttaacatattgaaaaacaacacaccaatgaccgcaatcgaaagcagtcccgaaataagcatcatggtaataaccattctatagccatagttaatcctttcacccaaatgcatgttttccaatttctttttcatcgcatctttttttgaagacatagtttgttatttcctcctatcttatgataccttttgaccctttaatcatattattatttatactcaagtctgaattcgtcagatgaatttagtatagtactatttttctaagggcacaatactgtattctcaataatctttatgtgaatctttctattaaatatgtggttttgcacaaaatggtatgattttttcgcaattccctcaaaatacatatgatgattttgtcttgttttatgtaatgatgtaagtcccggtcgggcagccggggcttgcagttatatattcaagagaaatcagctcagaagtgaaaatgcaaataccacaatgccaagtattacaagcacaatgcctgtggcacggtttaaggtttttgcggatgccttgtttgcaaagaccgctgcaattctcgcccaaaggagtgtaaatgcaatacataaaagcagcacaaaccagtccggttttccaccgatggcaaagtgcgaggcagctcctgtaaaggctgtaaatgccatgataaatacgctcgttccgactgcagtcttaagctcatagccaagcactgatgtgaggatgaggagcatcatcataccgcctcccgcacctatgaagccacagataaatccgataagcacgccgcagatgattgactggacagctctctttttagctgaaactccctgcatggcctcctttgttgtcatgacaggacggactataaacttgattccgagtaaaaatgtcataaataccgaaaagttgcccattgttgctgacggcacgaggcttgatacatagcttccgacaaccgtgaagcataaaaccgtgaccatcattatgagcccgttttttacatcaaggttcttgttctttccatatgtataggctgacactgcgctggcaagtacatcagacgacagggctattcccactgccatataaggatccattcccaaaaatgtaatgagcatagggcttattactgctgctgcgcttagtcccgcaaagccagttccaaggcctgcgcccataccggcaaaaaatgttactattatagttattaatgtgctcatttgtgtgatttcctcctgattatttcatccatattattctcaagctgttccataacaatcgtcagctgctttttctgctcctcatctatccctgcaaacagatttgctgtaaactgctgctgtatacgccttcctctttcaatgacagtcccggccttttttgtacagacaagctccgtcttcctcctatcattttccacaggttttctctccagatagccttcattcacaagcttatcaacatttacagacacaagatttgccttgatttttcttatttcaactatatcccttgccgtcttatattccggattgttcgccagaaacatgagtatatcaaaggctgtctgcggaagcttcagctcatggcacagtggtctgcactcatcgctgtaggttcgcgaaattttctctgcaaactcaaagttaaatttcatatgtgatattccttcttttcttttcctattttgctgcttcgttatacatttttgaattattcatttttgaactaattatatatctctctgtcattttgtcaagcggttatcgtaatttataccctgcaatgctatactttttgaggcattttttcattaactattatgatatgatttaacagttatataataccttgaaagtatcctgcagtcatggtattatatgtaattggcgctttgttgcacattttaaacaccggctaatctaccggtgattttaattttaataactaaagcttcgtacatatataatgtaggagttttaaattaacaatcatttacaataggaggaattatgagtcaggaaacaaattcagcccctgtaacagagaacaagatgggaaccatgcctatcggcagacttgtatttaacatgtctttgcctatgatgatttccatgctcgtacaggctctatacaacatcgtggacagtattttcgttgcaaagctgtccgaaaacgcactcacagcagtttcacttgccttccctttgcagacactcatcatcgctgtcgcaaccggtacaggtgtaggtgtaaacgcgctgctgtcaaagtccctcggcgcccataaatacgacgaggccaacaaaatcggcatcaacggtgccgtgctatatgcattcagctacgtaatatttctgattctcggacttacaatcgtaaagcctttttacatgagtcagattggaaatgctgatatcgaaatcatggatatgggtgtgagctacctgagtactgttatgattttttcatttggtatttttgcggaaatcttttttgagagggtgcttacatcgacaggaagaactattttcagcatgacatcacagctttgcggtgccatcacaaatatcattctggatcctatcatgatctttggactgcttggcttccctaagctcggtgctaccggtgcagccgtggcaaccgttgtgggacagtgcgtagccgccgttgttgcctttgcctgcaaccacaaattcaatcatgaaatcagcctgagcttcaagggctacagcccggatttcaaaatcatgggaaccatttatgctatcggtattccgtcaatcatcatgcagtctataggctctataatgacatatgccatgaacagaatacttatcggcttttcatcgactgccgctgctgttttcggtgtttatttcaagctgcagagcttcttctttatgcctgtattcggactgaacaacggaatcacacctatcatcgcattcaactacggtgctcagaacagaaagcgtatggttaaaacaataaaggtcagcctgataacagcattctgtctgctcttcgttggctttgcctgctttgagttcataccacaggtgcttcttggaatgttcagcgcctctgacgatatgctccaaatcggtgttccggcgctcagaataatcggcgtgcatttcctcatcgcatggttttgtattatcgtcggcacagtattccaggctttgggaaaggctgtcttttccatgatcgtatcaatcatgcgtcagcttgtggttttaattccggcagcatacatcctttcaaagcttggtggacttcacgctgtatggtgggctttcccgatagcagaggtgatatcctttactgtttcgacattattcttaatcaggatcaacagaactatcatctcaaagattcctgatggaagcgatgtgctgtaagaaattttacttgagctttaaaataatcaacaataaaatccgctgcattatatcatgtgcgtaatcatatgatatagtgtagcggatttattatatttatgtcatattttcacatatttctgatttctgcaccagcttggtgcagcttatgaaccgactttatcttgcgtattttcttacgtattttcttcctctattatacgtattttatgttgctggtcacactgttcggtgtgaacagtaacgattttatataaaaagtgtaatctgcagattcaaacctcttttaaaaaatgcgattttgtggtaaaatagcaaaaaagaaaatgcgattttgtggtaaatcgttgaaataaaaaatgcgattttgtagtaaaacatcaaaataaaaaatgcgattttgtaattttattaggagaatgtcatgtttaagcgaaaaatatatgataaattattgcaatggaaaaaggattccgatggtaaaacagcactcttaatcgaaggagcccgtcgtataggcaagtcaaccatcgtagagtcatttggacgaaatgaatacaaaagttatataatcattgatttctcaatcgtctcaaaaaatatacgtgaactgtttgaggatatttcagatctgaattatctgtttttgcagttgcagctccaatacaaagtcgatctctatgagagagagtctttgattatttttgacgaagtacaattatgcccccgcgcaagacaggctatcaaatcacttgtaaaagatcaccgatatgattatatagaaaccggttctctgatttctatcaaaaaaaacgtacaggatatacttattccaagcgaagagagaaagctaaacatgtatcctatggattatgaagaatttttatgggctttgaatgatgaaacaactatccccctaatccataagctattcgattctcaaaaacccttcggagaagagattaatcgtaaattgatgcgtgatttccgtctttatatgcttgtcgggggaatgccgcaggcagttgatgaatatatcaaaaccaataacttccgtaaggttgatgacgtaaagcgtgatattctgaatctttatgaagatgatttcaaaaaaatagatgccactggaaaaatatctatgctttttgatgcaattcctgcgcagctaaacaaaaatgcttcgcgatatcaggtatcaagcgtactgacaaacaatcgcgccgataatacactggaactgattgcagagttaaaagactcaaaaactgttttggtatcataccatgcaaatgacccaagtgccggtatgtcaaccaacaaagacttaacccggtttaaactatttttatgcgataccgggctgtttactacattgatgtttaaagacaaagatttcacagaaaacataatttatgaaaaattgttaaatgacaagctaggaactaatctaggctatctttacgaaaatgtagttgcacagcttttaacgtgtaatggcaacgaattattttactatactttttttaatgaaagttcgcgccataattacgaaatagattttcttattgccaaaaaaaataaggtttgccctattgaagtaaaatccagtggctataaaacccataagtccctggatgaattttcaataaaattttcaaaccgtattcttcaaaaatatctcgtatatacaaaggatttctcaaaagacaaagacatactctgtctgcctgcttatatgatttcgtttttgtaagaagaataactttttaaatatgattttaatacacacacttatatggaggattaagacatgaaatttatatcgtggaatgtaaatggactgcgcgcatgcgtccagaaaggtttccttgatttttttaacagtatagatgcggatttcttttgtatacaggagtccaagctacaggcgggacagattgaccttgacctgccgggctatcaccagtactggaattatgccgagaaaaaaggctattccggcacagccattttcgcaaaaaatgagccattatctgtgtcttacggcataggcattgaggagcatgataaggaaggacgtgtcatcacactcgaatatgacaatttctatctcgtaacctgctatacaccaaactcacagaatgagctgaaaaggctgccgtaccgtatgcagtgggaggatgatttcagagaatatcttaaaacactcgatgccaaaaagcctgtcgtactgtgtggtgatctgaacgtcgcacacaatgaaatcgacctgaaaaatccaaaaacaaaccgcaagaatgcaggtttttcagatgaggaacgtgctaaaatgacggagcttttaggttccggctttaccgataccttcagatatttttatccagatgccgagggtatatattcctggtggtcataccgttttaaggctcgcgagaagaacgcaggctggcgtatcgactactttatcacatcaaagcgcatcaatgataagctgcaaaaggcagcaatccataccgatgtgctcggttcagaccactgccctgttgaggttgatattgaattttaaatttaaggttatgtatttttacaatcccttatgcaacactttcttctcgagcttatccccatcctgtgtatactcaacagcattgtacgcaccgtttctgtatgcaaacgtctcattgtcatcctgataatgcacgaagctgcccttgcccggatatgtcagtatgctgatcttatcctctgtaatgtcctctgtagagcggatttctccgtctgcaacaggaataatggctcctgcctttatgaagacaggtactttatcaagtggtgcatctgctaaaatatatctgccgccactgtatttttcgcctgtgtagtaatcataccagtcgccgtcaggcagataaacctctcttacctccttgcccggtgcgatcacaggtgcaaccagtacaaagcttccgagcatatattcatcggaaatatttctcacatgcttatctgcaggatactcgtatacgagcgggcgcacgataggtgctcctgtcttttcacactcatgtgccagatcatagatatatgggataaatctgtatctgagctttactgtctttctgactgcatctatcgtagtctcgtcaaactgccaaggctcctgtctgcgtgttcccatcgctgaatgatttctgaaaaacggcacaaatactgctgcctcataaaatctgacaagaagctccggtgtagtatcacttccgaaaccgcctatatcgctgccgcacatggcaagtccgctgactgacagattgcacacctgctcgagcgaaagtgctatatgcgcccagatgctgtgattatctccggtccagccaccgcagtacttctggcttccggcatatgcagccctggtaagtacaaacggacgttttccaccatcatttttcgcaagtccctcatatgtggcttttgccataaaatgtccgtaaatattgtgaaccttttcatgtgctccatactcaaactgcacatcatccggcagtggtccgttgaagcttgcaggctcattcatatcattccatatgccactgataccgtgctcgagaagtatctttgtcttgtctccccaccagcttctgactctttgctttgtgaagtccggaaataccgatgttcccggccagacagcattttcatatacactgccatctgtatcatgtgcaaatgcatccatctccataccctctttgtacatgaagtagtcctcatccttcttcacacccgggtcaatgatggatatgagctttacacccctgtcagcaagcttctctgaaaggccctttacatccgggaatttcttgtcatcaaaggtgaataccctgtagccgttcatgtaatcgatatccatatgtatcacatcgcatgggatatcaagctcgcggaatttgtcagctatatcaagcacctcatcctgtgtgtaatagccccagcggctctgatggctgccgtatatccatctctgataaagcggtgtggtgcctgtcagtgatgtataaagtcctaccacctctgccatatcatttcccggcataaaatagtagtccagctcgcccttctcatgctcgacgaaatagtaatctgtgttttcataaccgaaatcaaaggttgtcttgtaggtattatccgcaaaaattccatagcaatattcatcgcccaacacgataaaaaacggtatggatttgtacagcgatttgaagctgtccacatgtggcgcaggatcatccgtgttccagtttacatatgaatatccacgcttgttgaggcatcccggcttatctcccagaccgtaaatagcatcatcctttccaagctttttgatgatggtaacagcgtcagtttttcttcatcttttccgacagtatgtccctcaagctctgcgatggcaagatcctcgtacggattcttctcactctttttgcgtgctgtttcataatctgaaagtacaagcttccctttgtaataaatatcaagcttctcgttatcctttacatttacagtaatatcccttgcacttatgactgctttaactgctgcatcgcttacaccggcttctgctgcggtccccttggcatcagacgtatccttgcaggtcacgtccggtgtggcagccttcggaataaagtcctcttctattgcaacactttcgatgccgtgtttttgtgcaacatgcactatgttgttttcaaatatggtaacaaacagactgccgttctcgtagatcagctctgctgtgttgtcctgtattttacagttcttatatgaatttttcattgcgtaatcctcccttatatcattatatagtttcgagttgtttctttgttgttactatagtaccatttgttggtatgttggtcaataactacctctctctttccctctgcgacaacggcacctcatttttcatgtaagtgtcccacacattcatgcgatcctgctcgtcaagcttgcgcaacacccttgccggcacacctgctgcgatacagttatcgggtatatcgcggtttacaactgcacctgctgccactatgcagttctttccgattgtgacaccgccacagattgtagcactcgagcatatccagcttccgtcaccaatccttataggctttgcatattcaaggtcatggaagccgtccggatattcctgcggcaggcgttcctctgacaaaaacggatggcaaggtgtcgcaatagtgacatttgctccaatccagactccgtcacctagctcaatcggtgcgcaatccagaaatgtacatttgtagtttacaaagcagcccttgccaaagtggatattcacaccatactcacagtaaaatggtgcaaaaatgaatgcaccaccatcctttgcagatggtatcattttctccaaaatacgctgcttacgcttcttcatccaaatcggtgtgcggttgaatttgtcacacagccccattcctctttcatggtagcctgctatgtctgtgctgtctgcattgtagagctttcccgctctcattctgtcccaattgttcatagtgtttctcctgatgtttcttataaaaatacttctgtttactataatagcatcatccattttttatttttacaataaagaaagtcaccggtcacacctagtatgaccggtgactgttactgttcacatctaacagtgtagccagcaactttctacaaaatacaaatttaaaatcaatagcatcaggctgtaagtatctctgtcaatacaccatacagctctgtatcaagctcctttgccttgagctctgataaaatcactgttgttttctttcccgatgtaataagaccgtagatttcatcctttagcacaaagcctatctctgcctgattcaggaaatcaaagcatcttttttcgatttgattatcaagcgctactgtgtctttcgatattgcaacgcttattttgcttgctgtcgatgcagttacagtaacgatgagctttctgttttctttatcatattcattctttgcccagacctctttaccgtccacagatacctttaccttaccggctgctgcctcggttcttctttcaaagacaagcttataggttctgttgtcaggtattaatgatgtatctccatctgccggagaaatgacaaacatatctttatccgcagaatatttcatagctgtggtcacacatctgccatccacatatccgcaggattcattgtcatcctcgtatagctcaaactcaccatcagcctccgggaataccctgacacataatacatcaggatttttgataacagatcttgcatcaagctcatcagcatctgcacacgcaagtatgcctccagccttcgcaaacacaggtatgctgctcaaatccctgtaaacctccagcattcttccaccatcatagcgcatgcctgtatagatatcataccagatgccctctgggaaccatactttggtttttgccacattaagtcccttaatacgtggagttgtaacaggtgctaccataagctggctgccaaagaaatactgattctttacctcataagcctctgcattttcaggatactcataatacataggctcaatcagcggcatattctcggcatagctgcgatagttcatagtatacagatacggaatcatacaatgcctctgtctgagcgctgcctccatcgcttcctcagtctcttttttaaatcgccacggctccttgccgttaaattcgctgcatgagctgtgcagacgcattatcggagagaatataccatattgtgtccatctggctgtcagctcatcatccttgtagccaagcatatgtccgccaatatcatggctccaccatccatatccgatgtttgtcgctgtcgttgtaaaatacggttgaaaatcaagcgactcccatgtaatatgtgtatctcccgaaaatccaatcggatatctatggcttcccggacctgcatagcgcgaaaatgtcattggacgcctgccgtctcttttattatcgagataatgaaaatgattaaaaatccatagcggatccaatccttcaaccttgcagttactgccctgctgccagtcaatccaccagaaatccacaccttcagcctctctcggatggtgaagatacttaaaatatgcatccataaactttgggcttgccggatcacatacaaccgggtcctcattttcatagtccacgcccatttcctttgccatatcaacatacatttcttcacagccctgcacaccatccgcagggtgtacgttcagggtagtatgcattcctctgtcatggagctttccaagaaagcgcttcggatccgggaaaagctttttgttccaagtatatcctgtccagccgcttccgtatttagggtccacatcaacctgatgccagtccatatctattactgctaccgtgaatgggatattcttttcatcgaatttgtccatcagctccatatagctttcttctgagtatttataatatctgctccaccagtttcccagtgcatatcgcggaagcatcggagtcttgccgcaaagcctgtaaaaatcattgagcgcctgtttataatcatgtccatatccaaagaaatacaaatcagacacacctttttttcttggctcaatccatccatcgtcaagtaaaatctgtgatttactgtcatcaagaattgaatatccaaagcgtgaaacaacaccgtgtccaagctcaacctctccgtttacgtcatcaagtgtacgcgctgtaccctgcaaatcatgcaccttctcgccataatgccagatgctgtgatatgcgctcaggtttcccttaatctgtatactcagtccgtgtgatgagaactccttctcattatatatcaggtgcagcattgatgtatgaacctcaattccatcagcgttacgcaccacatgatagccggtctttggaaaatccctgaacaatactgtctgtgttgccctatcctcgaatacgccatcttcactgtattccagacggacaagggcttctgtcagaactgtaatcctgcatttttcacctattatcatattgtccgataatgccaccggacttgtctttactctgtatatttcctgcatgaaataccccctctcatataaattacgttatcccttgacagccgatgccgcaattcaatatcctctttttgttcaaatcagtttagcgctaaatccgatctactccctgtgtgcacgcttgttttcatacattttccattatcttgtcaaatcttttacccacttgtattttttaaaatgtatgagtgtccacggtatctttccaacctcatccacgcaggtacacgcatataccacaaccaccggccagttcaaaaaatatgtgcctgcaactgcaagcggtattgctatgccccacatcgtaacagcaagagagtacatatcaaacatcgtatctcctcccgaaccaaagacaccgtttatgatgatttcatttaccgatcgtccaatcatgtagaaggcaagtacacctaataactgcttcagatactctgcagcctgcggtgtgagctttacaaaatgtaaaatcaccggtgctgaaaccgccataagcactgtcataacagctccacacaaaaatgacagctttgccattctgatgccatatgcttttccacgctttaaattccctgcaccaagctcatttcctatcataatgcctgctgcacttgatatacctgcactgagacagcaaatgatatcacgcacaaccgctgcgacggagttggccgctgctgcgtctgttcccatgtgtcccataaatgtagagtacgatgtaaagcctattccccatacaaggcttgctccgagaatcggtccggagcacttcataaaatctgctgacagctccttgttcctcaccaaaagctccctgattttaagcctgatatatcccggtctgtaagaaaatgtgattgaaagcataagctccagcactcttgatatgagcgtggcaagtgccgctcccctcacattcatgctctcgataccaaatgcaccatagataaatatggcattgagcattatgtttataagcactgtaattgagctgactgccgccgcagtacccgcgtgctctgatatcttcatcatgactatataacactgcgaaaaacctgttaataaatatgaaaaagaagctattttaaggtagcttacaccataatctataagcaccggctcgtttgtgaaaataagcatcagatatcgtggaaaaaatgcacatgccacgaaaaacagcaccgatactatgccacatattctgattgcaagagcgaatatgtcatcgagcgcctttatgtcctgcttgccccaatactgtgccccgagtattgcaagccctgctgtagcggctgaaagaaacatgttctggatgaactgtatctgtgtggcaagcgaaaccgctgacatatagttctggtccagtcctccgagcatgaaagcatctgccaccgccaccagcgccagcatcagattctgcaccattatcggaaccatgagtgtccacagctttttgtagaaatgtgtatcaaattctattgttttcataagtaaattttacctctatatataaatctctaaaggtttacaagtatccgtgtccatgcttcgcatagcctttcaaatgaccatgccgcatttgcagggcttgtggacggcagtgtgactgcctccatacctgtcagaggaagctgatatttcttataaagcgctcctgctttatttccgtttgcatatacctgttttatatcggctgtttcaaggattttccttatatctgtcggtttgacgtttttgatgctgctgtcgctcgaccccttgatgtcacagctttgtatcacatcccatatggctatgtgctttttcaacagcatatattttttctcatctatcgtctccggcaccggttcatccaacagatacgcaagcagcttccagaaacggttctgcttgtgtccgtaatagaaattgttttccctggattttactgatgggagcgtgccgaggatgaggattcggctgtttttgtcatagacaggcttaaaggagtgggttatgtgttcgtattccatattgttacctcttatatctgcagcagctcttccggcttatcaatacattttaactatactacaatgccgttgttttttacaacaatacgcatagttcccagaaaaataacttatgattattatactttatccatcttgatttcacaatcttttgttcacgacaaaaaagtagtcgtttcacttccacattttttgacgttataacccattataacccattgatgtttcactcaaaatgggttataatagattgtaagaaacggggtgatattatggatatctacaaacgaatttatgaattagaaaacgagatagcagccttaccacaaggttctatcaacatgaagaaaatttacggcaaagagcagccttatctgcaatggacagagaatggaaaaagcaaaagcaagtacattaaaaagaacgaacgcgaagaaatttttgcaggtgttgaaaggcgtaaacagcttcaagaagaattgaaagaactgaaacaacacagttctattgatccatctaaatctacagattttgaaacttctgtcattatcggagaacgtcttctggcactgacaaaaggtgtaaaaaactggggaaaacgtgattgtttcagacagttacaggcatatttaaacagtgaggaaacagatcgtgtatgcttggtatttggtctgcgacgaacaggaaagacaacaatgctgcgtcaggctgttttaggaatgactccatcacagtccgcaaaatcagcatacatcaaagcaaaagggagcgataccatggcagcgatgaatcgtgatttgggcaaactccttgatctgggatatgaatatgtttttattgacgaagtaaccctaatgcccgactttattgattcagcagcactattctctgatatctacgctgcacaaggtatgaaaattgttttatccggaacagattctcttggcttttggtttgcgcttcatcaggaactttatgatcgagctgttacgattcacactacctttattccattccgtgaacatagtcgtttactcggtatcgacagtattgacgagtatattcgctatggcggcacacttcgtgcaggagaactggattttgatgataaagacgttatttcagaggatgcttcgttccgtgatgacgaatccacacggcgttatatcgataccgcaatctgtaaaaatatccagcactccctgagttgttgtcaagacggaggatatttccgtcatctccaatcactctatgaggcaggtgaactaacaggtgctatcaatcgaatcattgaggatatgaatcatcgtttccttattcgtattctgaccgacaaattcaaatctcatgatttgggttcagctgctgatgttttgcgaagagatcgtaatcccaaacagcgtacagatattttggataaaatcgatacagaagcagtaaccaaacgattaatggatatgttggagattcacaataaagaagaacaatctattggtattacaaatgctcacatagaggaaatcaaagaatatttgaaagcacttgacctgattgttgacgttccacgagaaacggtaattccaagtgccgaaccactagagaatattttattcacgcaaccaggcatgcgttattgccaggcacaggcattggttcattctttgacaaaagatgaattattctctacattgagcgagcacgaaaaaatgttagtttctgaacgtattttggaagaagtgcgtggtcgtatgatggaagacatcgtacttttagaaacattcaaatcggctaaaaggcatcaacgtgttttcaaattgcaatttgctgtcggcgaatacgatatggtaatttacgatgctaaactcaatacatgtgaatgctacgaaataaaacacagctcgaaaattgttccaatgcaagcccgcttcttagttgacgaagagaaactgaatcaaacaagtcagagatttggccagattaccaagcgatgtgtgctctatcgtggtgaagattccgtcatggaaaatggcgttgagtatcagaatgtagaaaattatttgaaacatttataattttcccctaaagaaagagaggtccatgacatttaacatcatgaacctctctttctttattatcctctatgagccatccacttcttttgcttcttccagcaacggctgtagctcgtttgcttgagtgcaatataaacaccagaagtacaggttttcaaagctaattcatgaaatcgtttacacatacttaacagctgataaatactggaatgttaataattctacgcagcaaaaaaggaaccggaaaatccggttcctttttgatatcgcatcttttatgataaatatattctaactgcttcatataagtaatacacaaatcagctcagctctatctcatatgctccggcttcaaaatccaccgtaagaagcgcatatgcttcaccgttatcatagcggattgaaagctttggcccttctcctgctactgtgatgacagctcccttctcaaacgccttatgggtgtttctcatgcgaagcagctcaagctgtttttgaacaacctcctttttcatgccttctgcgatatcagaattgctaaggtttgttctgtttatttccttgtgtcctgattctcctgcgcgtcttactgcctcatggtcatttttgcctgcaaagagatccagataccatacctgcggcttgcccggcatgaacatctgaatagcacgggccagaagcattttgctgtcagactcaccaagcgcactgtaatatgtggcattcacctgataatatatattcttctgtccgtgaagatttttgaccatgccgccacgagatacaatcaaatctataagcgaacgaatatcatcctccggaagcagaccctttaaatccagaagaggtatgccgtcatggcagccaagcatattgacagtggagattttatcatccacaacctcacgcgcccatttggcaatgtaatctgctctcctgttctcaatcgcatcaattaccagtcccggtaaaaagaaatcatatgtggcatagcccttatctgcaagggttttgtatattttctcctcatatgccgcatgtatttcaggcagcagagtcagcccgagcggagctgcaagctcatggatctgctgtagaaattcccaggtctcagggtcattcaggaaattctttttccccggtgccttaggcgcataggcaaatgcatcgagccgcacaatagccgcaccataggatgctattttttcaagtgtttcacgataaaaatcccataccttttcggactttatatttaaatccatctgccccagatattctctgccatgcacctcctggtaaaatgtgttccagtatggcacccttcgtccatccggaaactcaaccatgagaatcggaagcccaggctttctgaaaaacatctgctttaagcatgactcatcaggctgtatgtagccctcgtccgtcatgactccatgaccttcccagaacttgttccagtctatgaaaaaatcccggtactccgactcatcgcccttttccacaagatccttgaactgtggtgactgtgctgaagcatgatttaaaataaagtcaagctttaagtcaatccccagctccttcaattgcgataaatcctctattgtcgcaagctcctcattcagattgtagtccacgaccgaaaatccgcggtccaaatccgaatgatacaggctcggcagaatataaaatgatgaaaatgtgtcctgcatttccttctttttgagcaacgctgcgatatcggaaagcttaccgcccagactgtcaggatatgcattaagcataggtttattgttcatagactttgccatcctttccaactatgatacgcgcatttttaccctgtaaatcaagcttttcctgctccaattctacaacgcggcatatgaaagggcttgcggcgttttcgtcacgtcctctcttaatgcggcgcgccttagtctcctcaggcgaactctccaaaaatacaggtatatcaacacccttaaggtattcgcttcctccatgggtccactctaagatgagcactttaattcctgtgaaatcagtctcgtcatatgagatatcaccgtcctcgcggcccatatgctttatctcaattatatcttttcctgccttaaactctgaaagctccttgttaatcctgtcaaagtcaatctcctcaggtgttccaagatatccacgtaagccatcctcgccggactcgttatacacattaaggcgctcctcgtcatttctcatcgggatacggtgtggataattgtccccggtcagcacatagcaggctgtattatcgttaagaaaatactgctgcagggctgctgcaatcgttgtctttcctgagcctgagccgccgtagatgcttattacaatacgtttatcagaagaactatctgcagtgtcagcctcacttaattttagattgccgcacaccttctttatctcatcatacagcttctttgcctcatcaagcctgataaatgaaaactgatatgcctcatactcctttgtagcaaacggaagcggtattccggcattcatcagtgctgcacctgtgtactgcctgccggtattttcctcaatatatactgcatcagactccaagcccttaagcttcacatagtaagtagccgcatttgcctccgcatacagacaaaccacgctcacaagtgccctgtcctttgcccttgaaacagacatccacgcagccacctcatcctcaaatgggcttgtaaggcgccagtaggtgccctcatttataagcatctcatacttcttaaaggtcttgatctgctctctgatttcttccttttcctcatctgaaagaagggccggattcagctcatagccaaaggttcctgccatggctgtgatgcctcttgttttaaggcttgtcactctgccggtctgatgatttggcactgccgatacgtgcgctcccatggatgataccggatagaagaacgatgtgccatactgtattcttgtgcggtttatggcatctgtattgtcactgcaccatatctgtggactgtagtagagcatgcctgcatcaaatcgtccaccgccaccgctgcagccctcaagaagtatatccggatatcttgtcaccagacgctccataaaatcataaactccaagcacatagtcgtatgcaagatttcctgcatacacatcagccatgcttctgttcatatcccacttcacgtagtcgatttttccctggtcaaacactgcgcagatctgattgaaaatattgtccctgacttcttttctcgaaaagtctaaaataagctggtttcttgagcgtacaggaagctttcccggaatctggatagcccagtcaggatgctctctgtacagattactgtcctcattcaccatctcaggctcaatccatattccaaatttcactccctgtgcatgcactctgtcgatgagctctgaaagcgttcctccaagctttttctcattcacaaaccagtctccgagtgatgaattatcatcatctctctttccaaaccagccgtcatccatgaccaccatatctatgcccagtgatgcggcctcctttgcaaggtctactatcgtatcgccggtaaagtcaaagtaagcagcctcccagctattgatgagcaccggtcttacctcatgtgcaaatctgctcctgcacacatgctcactgatgcaggtgtggtactgatgggaaagctgtgagaaaccgtctgccgagtatgacataatcacctcaggcactgtaaaggtctctcctgccgcaagcggatatgaaaacagttcatcggaaagccccattaaaaggcgtgtctggttaatctgatccttctctgcctcacatgagaagttgccactatatacaaaaagcataccatagcagtctcctgcattttctgtagtatcgcgctgtgcgagaataactgccggattgtactggtggctggaggttcctctgcggcttccgaatgaaagtgtgccgtgtcctaagtgtgtgcgctcaagattgcgctccatggcatgcttaccgtagaatctgatcacatcataatctccgtaaaccatatccaggcaggcagcatgagccttttcaattgtaatatttccactgcctgtatttttaatgagcacacttcttgtgatgacatcacaagcctcgagcacgccataaagcagatgcacctcaacgcctgcgatatcatcgccaagaactatttcaagagtctgcgcctcgtcatcagatgcccacactgccggaagtccctttagagcgtattttccatctctgatttcataactcttataaagaagctcaacactctcagtgccctgttcgtttttgatatcaagcgcaatatttctgaaatcgcctgtgccaagtgtcggatactcctgtggcagcgtatcaagcgaatatgtacggttcatgcctgctgcgtaaggattgcctgaaaagcctctgtcagcatatgtcagaacatagtccatatcacatgtgctttttgctccgtagtacagatgcagcagatagcccagtctgtccacctgcatctgatatgtggtgtgagctgtctgtaaagtaaaaattttcttgtttggattaaatataattgccataaaatcactccatatcattgttaaaatagtgtttaaaaattatcccttgattgcaccgtttgcaacaccgtttaatatctgcttctggcagattatatagaatataagtatcggtatcaaagccagaatatatgatgcaaatgccagattgtagttggttccaaactgtgtctggaaattcagctgtgccaacggcagtgtattctgtcctgttcctgacatgatgacaagcggtgtcatgacatcattccatgtaccgagcgctgtcaggatggctactgtcgcatgcataggcttcatcataggaaatacaactctccagtatgttgtccatgtgcttgcgccatcgatgtctgcagcctcctcaagtgccatagggatatttttcaagtatccactatataataatacattcattggcatgtaaaatacaagatataaaatgataactcctgccctgtttccaagtcccatctgcgcagtctgctttacaagaggcatcatgagaattgagaatggcacaaacataccgcttacaatgtaaagatatatgaaacggaagctctttttccttgccatgcctcgtccgataacatatcctgcaatcgaatggataaggattgcgagaacaatggtcacaatagtgataagtaagctgtttccgagagaatgccagaaatcagtcaccttcatagcctctgtgaagtttgaaaagctccactttgaagggaatgaaagagctcctgcgacatcatttgtcatctcactcggtttcttgaaggcaatgataacagccatatacagcgggaaaaatacggttaaggttcccaatattaaaacgatggttagtacccagtttgttttttgttttttcattataactgctcctccttcttattcataatacccatctggaatagtgaaatagccacaattacaacaaagaaaattactgcgtttgcactttggaagccaaactgtcctccatccataccatttctgtaaatcaggtatgagattgactcagtgctctgcgccgggccgccctttgtcaatgacataatctggtcaaataccatgaggaagttctttgtgctgagcaccagattgattgtaacaaacggcataacgagtggaaacgtaaccttccagaactgtttccatttgcctgctccgtcgagcatgctggcttcgtaaacatcctcaggcactgtctgcagtccggatatataaatgattgtattcatggcaaccgcctgccataccccgacaatcagcacgccaatccatgcatatttttcactcgccagaatactgttttgtaagaaaccgatgttgaaggtatttcctactaccggcagaatatatgtaaaaataaagctgaaaatgtaaccaataaccagtccgccaaggatattcggtacgaaataaacacctcttaatgcactcttgccgcggatattgctgtttaacgcaactgccattacaaggcttaatacatttacaagtacggttcctgcaatcgcatatttaaaagtaaacagatagctctttccgactctggcgtcggtaaacaggtctgtatagtttctaagtccgacataatcatatgagccatagcccttgtagtttgtaaagctgtaaatcacaccctttatcatcggcagtgtgttgaatgcgaaaaataaaaccacaacaggtatcacaactgcccagaatgtcttgtctctatttgacattttctttttcattttgcatcctcctgttccttctggtaatcctgtacttcacgaatcagatctctgttgtaacgcttccagtctgaatcaaatttctttaagaacttctcctttgcattgtcgcctgtgtcaagcagatatgtctgaatcatggcatccacgctcatctcacttggataatgatgatcctgataatccgacatacggttgtcctttatatactcctgcatatccttcagtgtatccggtattgcgaaatctccatccttgcaggcaattccgccctggtcatccagatatgtctgaattgtctcatcgctgtacagatattcaagcacctcgtatgctgcttccttatttttgcaggccttcataactgaaaactgtaaatctattcctgaatttaacacattgtcagcctcattatcatttgccgggaaagtaaatgaaccgatattcatatcaggattaactgacttaatctgaggaatagcatagcttcctatcgtgtacatggcagattcacctctggcaaaggctgtacatgcgtcattgtagctgtaagcatatggattgtcctctgcataatcaagtaatgtgcgtatcttgtcggcaatcggagaatatgcctcctcaaatgtcgtatttcccatatttacctgattacaggtgtctgaatcacaaagacctactgcaagagcattccacggtgccagacaggtccatgtatccttaaagcccaaatacaaaggaagtgttccgctttcctttatctcatcgcacagtgctgtaaactcactccaggttgtaggcaccttccagccattctccgcaaacatatccttgttgtaaagcactcctgctgcatttgcggcgtaaggaagtgcataggtgccatcctttggaatgaactcaagctccttgtccatatccagatatgcctcttttacactgtccactacatccagatctgagatatcctcaaacaaatctgcatccaggaaatttgaataattgatatctccacctattgcaatgatatccggataatcctcacggatgaagcgtgtctttaaaatagtcatagcctcattcggagatgagatagtcagatgaatatcatcgtgagtctcattaaattgcttctcaatcttctcgaaagccttaacagcctccggcttataagaaaccacctcaatctcagtttttccgtccgcccgcttttcatttccacatccggtcagtcctgtcgtgcacattccgagtgccagcacaaccgccatagcctgacaaatctttctttttgccatattttttcactccttttctgttttatttgctctttttcctgataaaccgattataacataccattatgcatacaataaatacccttatttttgcttttttatatcaatatgctataaaatatgctataattgcatataatgtcgcataagggtatatttatagtattaatcaataaggagtgactcacatggacaagctttccttcaatatttttccaaatgtaaatttcatagatttgtgtatgtaccagttcggccacgagcagtgcgaaccgggacattcttttggtcctgccacaagaaaccactatctattccactatgtactgtccggcaccggcactctgatggcagataatgcaaagggcattacacaaacctacaacataaaaagcgggcagggctttctgatttttcccggccagataaatacctatatcgcagatgacaagcttccttgggaatacatatggattgagtttgacggtctgcgcgtcaaggaggctctcaccacaacagagcttacccaaaataatcctgtatatcacacacactcaaaggatatccgcgaaaagcttgttgaggaaatgctctacatcacaagacacccctcagaatcaccatatcacctgattgggcatatgtacctttttctggattatctgatgcagtcagctaaatcatcaaaactcgttccgggtgggaaaatgagtgatttttatataaaagaagcgatgaattatatcgagcagaattttcagaatgatatctcaatcgaagatattgccagagtctgcggcataaaccgaagctatctgggcaaaattttcaaaaattccgttggacattcacctcaggaatttctcatgaattatcgtatgataaaggccacagagcttttaaagcttacctccttatccatcgcagatgttggttctgccgttggatacgaaaatcagcttcatttctcacgcgcctttaaaaatatctacggagtggctccgagggagtggaggaacgagcataaataagctcactgttcatccttcacaaattcatttacattgtcatgggtcaccttctcatacggcagataaacatactttttatcctcaaactttatgtttttcatgctgcccccggtggctgccagataggcaagctgagccatagcccttgcctgtccctccttgtcattgtagactgttgccgcaagcttcgactgctgcactgcttcaagcccatcgtctgtgccgtccactccaaaaaatgcaggtacattcgactccgtcacaccaagcttttcgtatgcgtctatcgctccgagtgccattgcatcgttgtttgcaataaccagctctatgctgtttttatactgacctataagctgtgtcatacggttctgcgcctgagcacgattccagtttgctatctgacagctcagcttttctatctgaagaccgttattcttcatgctctctgtcacactctctgtcctgacgatggcatcctgatgtcccatctctccctccaggatgacgtactgtatcctgccatcaccgtttttatccacacccggattattctttatataatcggcaatgagttccccctgcatctgacctgactgctttgccttggccccgacatagtacagcttatcccagcgatttaaatcctcatcaaccggctccctgttaaagaaaataatcgggatgtccttttccattgcagcatttataatatgcgacaaatctgttctgtctgccagattaatacacagcacattgcagccgtcctctatcatctcctgcacctggtcatcctgtgctcgctgtgatcctgcagcatccatgattgtcatgctgatatcatatttgtctgtatcaagacttgcgcactcctttttgaaagtttctatcagctccccgataaatgtatccttctggtcatagcaggtcacgcctatatatatctgttttttctcgtcaactcttgtgctgctgcacgagacaaatgacaatatcagtgcaaaacacagtatcatcatggtatttcttattctgcttctcatttattgttcccccactactggctgattgcatacaaaagcttcttgttttcttcatcaaacagattttttctggtaagaagctggtaagataccggcttttcctctactgaatattttctactgccacgcagcatatcgaccagtcctacaacacttttgtatccggcagcaaattcatcaggtgtgataagagcctctgtccagcccgaatcgagataatatatggcttctgttgagtttcctatcccatataccagtgcaccctgcagattattatcagaggcttcctttgccgcctcaaccacacttgcatcatctattgcaagaactatgtcaacctttctctgtgactgcagatttattttctccccggtatccgaaacacctgatacaatccacatcacaacacagccgctctccgcgagagtatcctttatgccatcaatgcgttttttacaggcatcggattcagtgttttcacaatagattcctatttttttacctgaaagtgttccgttgttgtcagcaagaagcttttgtgccagttccgcacccatgctgtactggtcaaactccactgtatttaacgacttaaagctctcgcttcccgcctggtctccgacaaccattatcggtgtctttttatttatccggataagtgtattaaggcttttttcttctgtcattttttctgctgtcggcttgaaaacgaccgcatcagcttttttgtttatctcctgctttatgacatcaatttcatctgacatattgttcagattttccttacttatcataactacatccacaccatactcagaggccgccattttcatgccatatttaaacgcagcactgtggctttcatccacatcagccatcacaactgcaatacgctccggtttctcattgaacttattgtatgcgataaaacccattgctatcacaagtagtactcccagcagcagctctgttatgatgaagtttctcttattcttgctcatatttgtccatttatttttcactgtcacactcacacctcccatacagcaaggcaattgtacttgcttcatgttatatgatgctcctcaaattgaagtctgttttcctctgaatagacaattgccgggattttgattgtcacaactgttccctcatcaagctcactttctatatgcaggccatagcgctctccaaacagtatctttatcctgttatttacattgacaagccccactcccgagcccttcttgtgaactctgtccgtatttgtcagcaaaagcggaatttcattctccggaatgcccattccgttgtctgataccgttatgatgatatcctctcccactttttggcctccgactactatctctccgaaatcgtccagctctctgattccgtaatttagtgcattttccaaaatcggctgaagcaccagcttcaccgcacagtagtccattatttcctcgtctacctcaaagctcacctcaaatttgttcttatagcgcaccttctgaatattcatgtagctttttgcgtgcaaaagctcatcgcgtacaggtattatggtatgtcccttcgacagactgatacggaaaagctttgcaagctgcgtaatcataaacgaggcctcctcgtttttgcctccttcaatcatccatgtgatggagtcaagagtattatacaaaaagtgcggattaatctggctttgaagcacatcaagctcgctctttcgtctctcgttctgctcccatacgatctttttcatgagctcattgttctgcttatatgaattgcgtatagagtatcccagatgccgtatctctgaggaaccacctacataaatatctgcttcattgccattctcataccttttcacagaatcatccagcttcattatcggctttgaaatacgtatagctatcactctgtttatccacacaaacatcatagccataataatcattataacaaaaacaaactgcttcacatccgccatcttattggtaaagatggagtatggcatcacacatacaagcttccagcctgtgtagctgattgtatctaccataatcttacgatgcactccattcagataatcatcatatatactgttttgcgactttgccgcaacatcgctgttttccggaacatctccatcaaactgtatctgatgcggatggtaaataatattgccatttgcatcacacagataataatactgtccttttcccgatgtatttatcctctcaagcatccttgatacactcgaataatccatgtccacaagcatcacacccatctgtgattctgaaccggaggtcagctccacggcacggcttgatgatatgaccagatgatatctcatggaaccatcgtcaaacagattctgtacatgaggtgttgaaaaatgtatattttccatgcgctccatagcttctatgaaccagtcctgttttgtcacattggggtcctccttctgggacacaacaggctctgcagctataaggcttccatactgattatacaaggcaatactgcgcagatattccttgtttgactcatagagcaggctcatgccttcgtgtatgctgtcagactgctttaaaatatcattctcctttattacattataatacgccgcatccgaaacctgcctcatattgaccagatagctttccacactgtctattgtctggtccatcaccttatgattgctctctatgatactgtcctgcgatgcatcggcaaattttatatacatcaccacaactgtgacaagcattattgcaaacgacagcagtgagaatgagagcattattatggattgtatattgcctgatttataccttatttttctcatactctgtcctgtacctggatggggaaaccccatactttctcttaaaaacataactgaaatagttcggatccgcatagcctacattctgggctatgacatagctcttatcgtctgtctccacaagcattctggcagccttgtccattctgtaatcagtcagatactccacaaacgagctgccggtttccttcttgaacagacttgaaaaatacgagttagatactcctaattccttacatgtatcgtcaagtccaagttccacacttctgtaattcctgtgcacataatcctttgcactgtctatgagtgacttcttggagttgtatctggcatcagccatatcatcatgcagcctgcttgaaaaatccaaaagccactgcttgagcaccaccggctcaaaattggagagctcattataaagcctgcctacacttcccgatatttcctgcgcatttagctcattattgctcatgaagtgatatagctcactgatcagctccattactgccacatggtagttctcaagtgactgctgcgacataaaactatgctgcatatacgcttccacagcctgctctacatcctctatcttgccgatacatatcattttaaataaatatgacagctcatttccctcatcgccatcctttgatatacgtcgctgtggctcaacctctgtcatgtttattgctctgttgctgccataaagcaccctgtaggatactgcctccctcgcactctgataagagctcaccagctcctgtacattttcgcacacctgtccgattccgaccgtcacctttgctcccattacatgatttacatatttgcagaatctgtcgcactcatctgtcagctcagagatatcctcctgctgcataagctgggctatcatgaccgtatcaccgagatagttaaaaatcctgccattccagcgctcctttaaatcagcctgtgcctgtcgctctactgacactgcaagcagtctgatatccatgccctgcggcatctgacttgcggaggtatgtataataatacagcagtaatatggtccctcaagcacaatcttatagtcacgcatgtacctgcccagctcattttccggtatgcgtccctcgataagtgtcgtataaaagtttgactgcaaaacaggcaacgatgctgcataatactgcttcaatatgtctgtgtttttcttctcattcagctcatcatccagctttgtcttaagctttttgaatacctctgtgatttcagccagattgagcggctttaaaatatactcctctatctcgagatgtacagcctcctttgcatactcaaaatcgtcgaagcctgtgaaaagcaagagcttcgtcgcaggaaacctctgcctgatgttactgcacagctcaagtccgtccatgtaaggcatacgtatgtcagtcatcacaacatccggctgcatgtcctccatcatttcaagcgccttgaagccatttcccgcatgtcctaccacatgaaaaccaatctgctcccaggatacctttctctcgattacctctattacatcctcttcgtcatcaaccagtaataatgtatacattttatgtcttctccctgcttgtaattattgaactgcatacaccataaaatccgtgtgtagcataaatttatcccccggatattaaaatgtgtctgtatagtattataccacatctgatatattcttttatagctttacataaacaaaagtgtaactccaaaaatgaatttctaaattccaccgcccaatagggtgatggaatttactctcgcacagtagatatttactctttcatacaatcatgttatggttatgactccttctgacagcagtagaaggagaatcattatgagtaaatatataccaggaaaccagaaacaccttactttaaatgatcgtatctatattgaaaatgaactggcaaaagggactccctttaaagacattgcagcatttctatgtaaagatccaacaactatatctaaagaagtccgtgctcatcggctttcagattggtatcacaaaggtactttttataacgcaaagaacttttgcattcatcgttaccattgtcaaaagaccaatgcctgtggaaaaatccttctctgtggcattaaatgtgcctcatgtcctacatgtaatcaaacctgcaaggactttgaaaaagaacgatgtaaacgattggacaaagcgccatatgtttgcaatggctgcacgaaaaagataaatcactgcacgattgcacataaatactattacaacggccgtgctgctgacagaaaatatcgtgaactgctgatatcttctcgttctggaataaatatgaccaagcaccagctccatcagaaagaccagatcatatctccattaattgagcaggggcaatccccttatcaaatccttacaaatcacccggaactggatatgtctgtccgttctatgtacacatacattgacaaaggactcttcacagcaagaaatattgatttgaaaagacaggcaaaattcaaaccacgaaagtgtcataaaacacaaatcactgatcgttctgtttttacacacagaacctactctgacttttgttcattagacctgtcgtcttttgtggaaatggatacagtccattcctcaagagaatcaaacaagactctcctgacactgttttttacgaaagaaaagctatttcttgcctttttacttaaccgatgtaccaaaggtgctgtaagacttacctttgaccgtttagagaagcgcctgggcacatatgaatttatatccgtttttgaaaatatattgactgatagaggttccgaattcggagatccggtaagccttgagacaggcattcatggaatccagagaagcagcatctactattgtgatccaatgcgcagcggacaaaaaggcgctatagaacaagcacacacaatgcttcgtatggttttaccgaaaggaacttcttttgaattcttaacacaatgggatgtgaatctcatcgtaaaccacatcaactccactccgcgagaaatcctcagtggaaggacaccatatgaagttgcattagaaacgcttggtgaagatatcttaaaagcatttcagcttaagccgattgaaccggataaggttaatctgacgcctaagctgatacgctttaaccattaataaaactaatcgaaatctgctgtcagactggatgtaaatttttcacatttttaagatgcggctggtggaatttagtctagcacaccgaattccagtagcctatttagcatgtctagaaatcgagaaaatttcgataagtaacattaattatagcagaaaacgagagatttagtccaaaaatttcttgttaaaccagcaaaatttaaatcacgatggaatttactcttgcactggaatttactttttcaagtcagccaaaagtgtaactgttaaagaaaaaagcagagatgccgccctgacatctctgctgatcattttggaagtatgaaaaagaaattttcttgcgatattatttcttctgaacgtatttcagacagtcaagtgtaactgctacaagaatgataattcctgagaatacgaactgaaggtttgtatcaataccaaggattgtaagagagtatgtgagtgctgtgaaaatacatacaccggttacaacacctgatatcttaccgataccacctgtgaatgatacaccaccaactacacaggctgcgattgcatccatgtcccagccctgtccataagctgctgaacctgaaccaaccattcttgcacactcaagccatgagccaaatccataaaggataccggccataacgaatgcgccgagagttactgcaaatactgagatacctgaaactgctgctgcctccgggtttcctcctactgcgtagaggtttttaccaaatgttgtcttgttccagataaaccatacaattgcgattgctgctactgcccagatgatgatggttgggaaaccatttacctttggaataatcatgttagggatgaccggctcaatagcaccgaatgaaactccctttgtagcatatgttacgataccgaagataacaagcatgttggccatggttgaaataaacggatgcatcttaaacttcgctgtaaaaaatcctgcaatacttgtgaagaatgtacaaagcacgatacacgcaagtaatgcgataaccactcttgcacctgttggtactcctgtaaagtcaaatatatgaccgaatacagagcctgtattgataccctgatgcatgatgattgtggctgttgtcatacccataccaaccattcgtccaacagaaaggtccgttcctgttaagaggataagtcctgcaacaccaagtgctaagaacattctcggtgaagcctgctgaagaatattcagtatgttgttgtatgtcagaagaggtgtgcccttctttatcggtgttatgacacaaagcgctatgaatataagtataattgcaatataaagaccattctgtaacaggaagtttctcctattgaacgtatacttgtaattctcccatttctgagctcttttctccataaatgtgaactttgaaagacgaagcatatcaatcaggtgatacttgtagctgtatgcctcatgctttttgtccttgatcgtctgatactctttctcgagctcaagcttctcattggaaatacgattcttgtgtacgtagttttcttcctttatctcagtgctgtctgatgtctttgcaagagcagccttgtgctttttatcaagctctgccattctctcattatgagcagcaagcgcctctgccttttccgcctcacagcttgccttaacggcattgtaatactttgaatcaaaattttcctttaaatagctttcagccttggcaatgagctttgaaatctcatccttgttctttgcctcaacagcctttgcctttgcaagctctttctcgcaggctgctatttctgactctttctcgccctttgaaagagttttatctctcttgatgcctgctatcgctgactgacactctacaacctttgtagttccgtcttttctgagtgcatcaatttctttttgtattccaccaacatattcgtcgataggctggcgcagagcacgctcctgctcagccgttaaaatcttactattagccatatccgtcttctccctttattataggtactttgcactgagtctcagcagttcttcctgattggtttcctttgtattgacaattcctgagagccgtccgtttgacatgactccgatacgatttgttataccaaggatctcaggcatctcagatgaaactacaatgactgtcttaccctgctttgccatattgattatcagctcgtaaatctcatatttggcacctacatcgatacctcttgtaggctcatccatcatgaatatctgcggtcctctttcaagccatttaccaaagataaccttctgctggtttcctcctgacagagccgaaatcatatcctccggtcccatacactttgtgtgcataatctttatctcatcagaggtggcctttgtcatcttgctgtctgaaagtgccggtccattcttataagcaccgagatttgcgattgttgtgttaaaggtgaggtttcccttaaggaaaagtccatttgcttttctttcctctgtgataagtgcgaagccatagtccatagcctcctttgcacaggtgaaattcataagctggttcttaaaatatactcgtcccgcagctcttgtcctgattccgaaaatcgtctcaagaagctctgtacgacctgctccgacaagtccgtatagtccaaatatctccccctcatgcacatcaaatgtgatgtcctgcagatgtggctcgtactttgtcgaaagatgctgtattgacaagattacatcctttggtttgttgtctaccggagggaatctgttctccagtactcgtccaaccatcgctgcaatcagttcattcatatttgtttcttttgtgctctttgtcatgaccagatttccatctctaagaactgaaatctcatcacatatctcaaaaatctcatccatcttgtgagaaatatagataagtgaaataccctggtcacgaagcatcctcatcatctggaacagcttttcaacctcctgtaccgtaagtgatgatgtaggctcatccaatactataacctttgagttgtatgatattgcctttgcaatctcacacatctgtcgctgtgatactgacatatttttcatcggctgctcgagattaactgtcattcccagctttctgaataattcagacgcttcttttttcatgcgtccctcatcaatcataccaaatgaattgaccggatatcttccgagaaacagattgtctacgacatttctctcaagacactggttcaactcctgatgcaccatcgctattccattttccagtgcatccttaggacccgaaaagcttacctcttttccgtccagatatatagttccctcgtccttctggtatgtaccaaaaagacatttcatcattgtcgacttaccggctccgttctcccccatgagacccattacagtaccttttttcacatctaaattgatgtggtcaagaaccctgtttcgtccaaatgacttgctcatgccacgaatcgataagatgttttcattattcttatcgcccatacttcctgctcctaactctatatttgctgtcgtctgtatacactttattttggggagagatttttccctccccaactaagtgctttaaatacttttactggttcaaaagagctgtataagaagctgcattatctgtcttaaccatgttgattgcgaatgcatcgtactggcttggatttccaagtctgtttgtgatattagactctgtctgtccatcaccaccgatgtactcaacatcaagatttaagagatcatcatacttctgtaagagtggctgatatgtagagcttaagaagttatctgaagcattgtagatattcagccataccttctttgtagggtgctttgctgaatcaagctgtgttgaaacaggtgcccatacaactgttgaatctgtgaaatccttgtagttatctgctgtaactgctacgtttaatgcgtagtaagatctctcatcatccttgtaaacatatacatcatcgcttaatacgtttcctgcatcatcctctgtgccgatacctgtatcaatatctacaccatcgagtgcgtttctaagtacacgaagtgtgaggtaagcctgaacgtcagcatgctggctgattgttccgccatagccctctgcgatagctgctactgcatcactgttggcatcgtatccgaatgttggaaccttgttgtcctttgaccatgcattgaacattgacattcccattccatcgttgttagaaacaactacgtcgattgactcgccaaatgatgatgaccatgttccgattgcatttcctgctgtagctgcatcccatgtagctcctgctgagttcttcatctcctgtgaagcaagctctcttactacatagtctttgccgtttacagtaatcttgccgtcctgaacctcagctgcttttccgtctgagtttgttcctgccggtgcactgtcaatctcgccgcccttgtctacgcctgttccaagagctttacgaacacctcttgttcttgcaattgaatcgttgtgtccgatatcaccgattgcaagtacatatccgataacgccatccccatttctgtcgatcttatcgatgttcttctcgatatactcttttaccatttctccctgaagttcagctccctgattagcatcgaaacctacataataggtatccttgttgtagttgagtgctgttgtgtcaagctctcctgttgagctgtttgatggctgacggttgaaccacacaagtggcttgtccttgtttgcaacatctgatgtcgttgtgctgcttccccctttctgtgtaccagaagaacccccatctgatccacaagcggccattgacgctgccatagcagctaccatcatgattgcaacaaattttttcttcatatatttttgtccccctttgttttgttggtaaggctagtatacaaaaatatttcgggaatcactatagaatatttttcgataaacattaaaaattttactgtttttcgtcatgtagacgaaaattttctagtttttattttttcgctacgtcatattgttcagcttcaacaaaaacgggctttccgctttgtccttattacttcctttgctccgtcactcacaaacattccaatccctcttttcttatacaaaattcctgcatccacaagtatatttatgccctttgccgctgtagacggatttatcgcatacagctttgcaagctcgtttgtgctcggcacgcgctcatcctccaaaagcacatcccgcagtatgtcgttttctatcatttcgcttatctgaatatagattgatttctcctgattcagaatttcattcacatgctccgcctcttttctatacaaatagaaaacgttatacgtatggctgtatgtacagtttacgtttggtatatggttaagtatgctgtacgtataaaatacttagaaccagttgtcagtgattgaatgaattacgggtacaaaaaagcaccatttataggtgctgaaaataaagaaaactataagcaatacttattgtagcatgtgtaaatttacacttcaatcacagagatgtgccaatattatgtcatagcataataaaagggattagatgaacactatctaatccctaaaggttatggtgtaacgatatttagtttctctattgcaacttcagtgtcaagtacattattctcaaagaaatagaaagtaatttcttgaccagcctctaaatgtgtaatgtcgagagatgatttgttgcaatttaatgtaatattggtaccatcaaaaaaattatttttttgactgatatcaacacagatttttttttgagagttatctatggatgtgatgataccgtttgaatggaaccaatgagtattatcatctccggaaatagcattttcttccataatagaatctcctttcatggaaccatttttatgtatgaatatcacaacaattccgcttaatattaatacaaatattagaataagtagtcgcttttttttatccattaaaagttgtacctcgcaaatcagtccagtttccaaaatctaaatttaaatatcgtacatattcattccaaccatcaaagcttcaaccggaatacctcgaaagcaccagctttatccgatgctcaaggcacttctactccagcgtatttttttcaatcccgacagatacgctcctgattgcgttcctagagtactctcaggaacttcgtgatttctgcgactttgatgctgttccagatggttccaaatttacacgttttaaacaggacttcttgttggatttacgatcttcgaagacattggatttcgtaatgcttttattcctctccgtgcctatcctggcatagaacgtagctcgaaagaatgggaaaatacttacaagatccgtgtaaatgttgaaaattcaatcaaccatttcaaagatagttgcaacattgcgaatcgtaagacccagaatgagaaaacgcttcatgctgatttacttcttgccggaatcacccagcttgttactgtaattgtcgctgataagattcatcagtacaaatacattcggagtttgaagcccttgattgcctgattattaatatgcatataatcttttcttcgcagtttatctgggaaatcttttagtcatgtctaaatttagaagcacctacttttcatctttaagaatcctacgttgcagaattcttaccgctttctaatcaggagtgcgcacttgttccgcaattacctacttgttgtactttttattatcgtaactatccagaaccaccacacacattcgcaaaaccgcacgatatttgtactttatctgcactctgtttagcatcgctgctacacagctaatttcgctcatatttgcggtatggttgcatggttaaccactcaagtaactaacctatgaacttataatagataatataaataatactgtcaactgtatttttcttcatataaaaaagaccatacactttaattcatcttattcccaacagcactatggtaattcaaatgtcatcctctcccctgtcgcaggatggtcaaaaacaagcttgtaggagcaaagtgcaagctgctccctcacaccgccaccggtgcgtcctgatttgcttcccattcctgagttatttgaggcaggcttcctatacttggtatctccaatcagtggatagccgatatgtgcaagctgcaaacgtatctgatgatgccttccagtgagaagctttatgtcaaattctgttctaatgcattcattttgggagccgtccctatccggcgtcactgatatcaccctgtactgaagcactgctttttttgccagcctgtctttttcgcttgtgatttttgatgtattggtacgcttgtcgaatgaaatataatctgtaagagtatgccatgccggggcatgattatcttctttcttatctgttcctgacactccctgtcctctgcttgccgcacgataatatttctcggttgtatgctcctttatttgtctgcttaaagaagccgctgctttctgattcttggcaaataccatcactccctctaccggctggtcgagcctgtgtactatgccgacataaggcggctcatttttagccgccctgtaatttcttatgaagctctccatatcctgctgccctatacgcctggtctgtgtagcaattcccgccggtttgtagcagatgattatgtcgttgtcttcgtaaatgatatctggttttcccatgttgtaactcccgcaaattgttattttaaattttaactgttcagcacatttacagttgcgatacgcaagcatatagccaagtgtcacctcacatacaaacgaaggcagcaccggtgtaaaataatagttacttattatattttatcaacttaatgagttgttagcaatggtattaaaaaactaattccgacaatttaaaaccttttttgcacattctatctgttcctctgtaggaggctccaccccctcaagctggtatggtataccaagctccttccacttaaacacgccaagtgtgtggtacggcagcacctcaaccctgtccacggttttaagtgtgtcgataaactctctaagctgatttaaatatctctcatccgtggtgattccaggcacaagcacatgacgtatccacatttttttaccgttttttgagagatattgtgccatatcaaggatattcttatttgtctgtcccgtaagctttttgtgctcctcgtcatctatatgcttgatgtccagcatgaaaagatctgtatatttcatcagctcattaaatttgccgaagaacggttcttccacggtaaacggatttcctgatgtgtcaaggcatgtgtttacacctttttcctttgcaagcttaaatagctctgtgacaaagtctatctgcaaaagtgcttcacctccgcttactgtaatgccgcctgtttgcttccagtacgctttatagcgcatggcggtctttagcacctcctgcggtgtcatcagctttgcaccgtcattttcgccgcatttggcccatgtatccggattgtggcagtatttacagcgcatattgcagcccttcaaaaatactatatatctcactcccgggccgtcggctgaaccgaagctttctaccgagtgtactcttcctagtgtttctcccatgtttttcctcctttaggttgttgttgctgctacttttatttttatggtacggaattttcggcaacccgccgaccgggactttgcaatgctcaggttcttcgggctaagaggctgtatgaattatgattttggttttctatgcttgacgcgaccggcttttacgcgccttccgaaaattccttacgctgtggtgttatttagaaaatcagaatatgcaggcacttggcctgcacattctggaatgttggatatttttttatattacattctctcgtggcatgtacgtgagattacatcgagctgctgctctcttgtgaggtcgatgaacttaactgcgtatcctgatactcggattgtgaagtttgcgtactcctccttctcaggatgctccattgcatcgatgagcttctctttaccgaatacgtttacattaaggtgatgtgcaccctgatcgaagtatccgtccattacgtttacaaggttgtcaattctctctccctcgttgtttccgagtgctcccggattgatggtctgtgtatttgagattccatcaagtgcccactcatatggaagctttgtgagtgagtttaaggatgcgagaagtccgttctgctctgcgccgtatgatgggtttgctccaggtgagagtggctctccggctttacgtccgtcaggcattgctcctgtagcttttccgtataccacgtttgatgtaattgtaaggattgatgttgtaggctctgaatcacggtatgtgtgatgcttctttaacttgtccatgaatgtcttaagaagccatacaccgatttcgtccgcgcggtcatcatcgtttccgtatttagggaactctccctcgatttcgaaatcctttgccagtccgctctcgtcacggactactttaacctttgcatatttgattgctgaaagagaatcgattacgtgtgagaatcctgcgattcctgttgcaaatgttctctttaagtctgtatccatgagtgcaagctctgctgcctcatagtagtatttgtcatgcatgtactggataaggtttaatgtatttacatagatgtctactaaccagtccatcatcttgtcgtatttcgccattacctcgtcatagtcaaggtactctgctgtgataggtgcgtagtttggtcctacctgctcacctgatttttcatcaacaccaccgttgatagcgtaaaggagacattttgcaaggtttgcacgtgctccgaagaactgcatctctttacctgtctgtgttgcagatacacagcagcagattgcataatcatcgccccatacaggcttcattgcgtcatcgttctcatactggattgagcttgtctcaattgagatgcgggctgcataatccttgaaggtctgaggaagctttgatgagtagaatactgtgaggtttggctccggtgcaggtcccatgttctctaatgtatggaggaaacggaagtcggtctttgtaaccattgaacgtccgtccacacctgttcctgccacgtcaagtgttgcccatacaggatcacctgagaataactggttgtatgaagggatacgtgcaaatttaaccatacgaagcttcattgtaaaatgatcgatgagctcctgtgcttcctgctctgtgaggatgcccttgtccatatctctcttgatgtaaatgtcaaggaatgtagatacacgtcctactgacattgctgcaccattctgtgtcttgattgctgcaagatatccgaagtataaccactgaactgcctcttttgcgtttgttgcaggtcttgagatatcatatccgtaaatctctgcaagcttcttcatatcctcaagacatttaatctgctctgcgatttcctctcttaaacggataacatcatctgtcatctgtccacagccacagtttgccttatccttctttttctcctcgatgagataatcaagtccgtataatgctactcgacggtaatcgcccacgatacgtccacggccgtatgtgtcaggaagacctgtaaggatctttgcatgacgaaccttcatcatctcaggtgtgtatgcatcgaatactgctgtgttgtgtgtcttatgatattttgtgaaaatctccttgagcttgtcgcttacattgtaaccatatgtctcagcagcctgcaccgccatcttgattccaccgtaaggcatgaatgctctctttaacggcttatctgtctgaagacctacaatctgctcgaggtcctttaatgactcatctatatatccagggccgtaagctgtgattcctgttacaacctctgtctccatgtcaagaactccgcccttggcacgctcctctttctgtaatttctggagtgcatcccacagcttgtttgtagcatctgtcggatcagctaaaaagctctcgtctccgtcgtatggagtgtagttgtcctgaataaactgacggacgttgatttcctctttccaaagacgtccttcaaatccatcccactctttcatttctatcattgtaatatcctccttaaaatgtgtgaatgttacttcgtttgattagttttgtttaactgtggttagtatatacttactacagtatttttgtcaatatccatgttgtttcttttgagatacattccctagttatttacacgactatggctgattttataatcaaaaagagccggctgtccgggtttatcgcccagacggtcggctcttatttgttatatttcatgtggttattccacttatccgtcagtcatataacacgttcatagtagactatttttctcaataaagcaataggtttttagaactatttttattcttttctattccgcacggaccgcccagcgcatcttcgtggacctggcacgtccgttctgagcacattcctgtgctgatggacgaatcacatccttggaatagtcgctgtatattcctgctttatatcctgccttgagtgcctttttgaccagcttgtcctctcctgaatggaaggtaaggatggcagctcttcctccgggctttaatgctcccggaagcttttccataaactcatatagcacctcaaactcatggtttacgtctatgcggagcgcctggaatgtgcgctgacaggtctttttgattatgtccttcttatccttttcaggcagaaaatcgagtgtctgctctataatgtgacgaagctttgtggtcgtatctatgcggttccccttcctgatctcgtctgtgatagcctttgcaagctcctcgcaatacggctcatctgagttctcatagagcatacctgaaagttcctcacgggatatattatcaagccgctctgccgcactgataccggcatttggattaagacgcagatccagcggtccatccaccttaaacgaaaaaccacgctcaggattatctatctgcattgatgaaactcccagatcggcaagtatgaaatcaaagcctcctacttcctttgcaatctcatctattgtgcagaagttttgaagctttatggtgagaatatcctctccaaagcctgcttcagcgagacgcttttttgtcttttcagactcgattgggtcaacatctgtagcaaacatatgtccctgtccttcaagcttttcaagcattgcccttgtgtggccaccgtatccgagtgtggcatcaaagcctgtctgtcccggctttatgtccagaaaatctatgatttcttttaccattatggatatgtgcatgcccgcaggggtatttcccttgctgatgacatgctcaattgtatccttgtatttctccggatttaattccttgtatttttcctcaaattttttgggatattttccgctataatgcacgcggcgcttgtgctgtttttcttcgctcattttatgctccgtttcattctgggttagaactgttatgctgacttttgctacagtataacttttattttacttttccgcaagataatgacttacattcctataccatctgcacgagccacacgtcgcttttcaccatgaagtatccgatgactacctttatcagctctgtggcctgcacaaggaagtacactgctactatgccaagtgctgtgtatttggcgagcacaaatgccaccggcaccactatcacccacgtaaatacggagtcaaacagaaatgtgaccagtgtcttgccgcctgagcggagtgtgaaatacgacgaatgtgtaaatgcacaaaacggcataattatcgctgataccgctatgaagcttgttgcgagtgacttgatttcatctgttgtgttatatatctgagggaaaaatccgcctaccagaagcatgaccgccgccattatagaacagcagaacacactgaacactatcatcttgttatccgcatcctttgccttttcaagctcaccggctccaagatactgccctacaactatgctgatgcatgcgccaagctgtataaacactatattgaaaaggtttgttatcgttgtcgcaatgtttaaacctgcgattaccgagagtcctcgtactgaatagcactgtgtaaccgttgtcatgcctgctgcccaaaaaagctcattgagcatgagtggcagccccttgatgaatatagtcttaaactcaccaaacggcattcctattcctctgtaagcgccctcgagatatctgttcttatccctgtttttatgtgcccacagtacaactattattgtctcaatatatcgcgacatcaccgtggcaatagctgctcccgccacacccagctttggtatcggtcctattccaaagatgagcagaaaatcaagcaccgcattgcttccaactgctgcaaagcttgcaaccatcggtacaaaagtctgtcctgtttcctttatgtttgtcgcataggcctgtgtcaccgcaaacggtataagacctatcataacaatttccagatattcctttccatatgccagtgctacctccgtggcaccgtttcctgccgtatctgtcagataaagtgatatgaaacctgttccgttcgtgataaacagtgtcatcgctattgctgtaacaaacagcgctgcatacagcttgaatctgaaggaatacatatgccccttatgatttcccttgccaaaatactgtgctccgaatatacttgccgctgacaccgccccaaatacagccagattgtacacaaatatgagctggtttacgattgctactcccgacatctgctctgtaccaagctgtcctaccataatgttgtccagaaagcttaccagatttgtgattgcattctggattatcattggtatggccagcatgagatagcgcttataaaatgccttgtctcctatatatttttgtctgaatttatgcatgtttgtccccctttcgatttctccatggttctttcgtgcaatgctactattctactacgtcagactttatttttcaaatattttatgtgtttttccttaacttattttaaataaaaaatacattaaagctcccaactgacaacactatttgcgctgtcaatcgggagctcttaattttaaattttaatatctaattgttatttttaattatagttttactttttatgtcaatatcctgtttatctgtttactgccgtttcatatcctgtgtttcctgatactttctgattacgaaaaacatggtagttccatcgccctctttgctggtagcccatatcttgccgccgtgatcctctataatcttctttacgatggaaagtcctatgccgctgcctccggtagccgaatttctcgacgcatccgctctgtaaaatctgtcaaaaatatatggcatatctctctggtcgattcctcgtccattgtcctcgatttcaacctgtatgaagtcaccaacatcatttatcctgatatctatatagctttgtgtcttgttcatatacttcaccgaattgccgactatattattaatcacacggcgaagctgctccggatcagcaatgataagcacgttgctatccacatgattctcatatgaaagcctgatattttttgcctcaagatcgagtcctatttcctcaacacagtcattaaaataatctgtgacatttatcttcgcaaaattgtatggaatcctgttcgtatcaatcttcgagtaaagtgtcagctcattaatgagcttatccatatcgtttgccttattgtaaatggttctgacgtatttatcgaccttttcaggggtgtttgccactccgtcaagtatgccctcggcatagccctttaccgcagtaataggagtctttaaatcatgcgcgatattgctgattaacactctgttttcggactcattcgtcaccttttcctcggcatttttcttgaggcgggcacgcatctgctcaaacgcagtacacagctcgccaatctctccgtcgctcggactcgtctcaagctcaaagtccagattgccatccttgatattttcagcggcaatacgcagcctctctatcggtgtgatgatactcctgtatatccacactataagcatggcagccgtagtaagaagtatcaatacaagtgcaaatgctccctctatcaaaacagtcctgacctcagggatcacacacgcggttgatgtcactatataaagactcgcctcgtcaccatcactgtcacgaaaattaagctgctttatgagcaccttgtcatcactgtccatatagctgctcacatcagagctgctctgcttattggatattcgcggaagctttctcaaaatatcatcattgtcaattccaccattgaaaatgagctctccttcacttttcactatgagatatgaatacttcttctccagcttcttatttatcttagtcagataatcactatcaagaagcctggatggttctatgagcgatgtcttctcgagctcatcatatgtgcgccctgtcaccttgttcagaaactgcaccgtgtcagtgagcgcgagcatgcccgcatcctccatgccatatgtcttgtttatggcctttagctgaatcttattgaaacccacaagcactatactggtgagcacaacaggcacaaaaataattatgcagaatgatatagcaagttttgtttttatcttcatagtattctccatttgaataaattaataagccactttatatatacaacaaggacatatcctttcgcatttgaatttgatatgtcctattaatactacaatatctactatatttttttaaaatcactacagcttaaatctatatcccacgccccaaatagtctcaatatactgaggctttgcagtgttcatctcgattttctcacgaatcttcttgatatgtacagtgactgtcgcgatatctccgaccgaatccatattccagatttccttgaagagctcctccttggtaaatacatggtttggattctcagcaaggaatgtgagcaggtcgaattcctttgtggtaaactgcttttcctctccgtttacccaaacacggcgggctgttttgtcaatcttgataccacgaatctcaacgatatcattttcaggtgtggcgcttccaatgagacgctcatatctggccagatgagcctttaccctggcaacaagctctgatggagaaaacggctttgtgacataatcatctgcgccgagtccgagtcctcttatcttgtcgatatcatccttcttggctgaaaccatgagtatcggtgtgttctttttctcacgaatctgtttgcaaatctcaaagccatcaatgccaggcagcataaggtcaagaataaacagatcaaaatcctccgccaaagcccttgcgagaccgcttgtgccatcattctcgacctctacctcaaagccgctcagctccaggtaatccttctcaagatcagcaattgcaacctcgtcctctactatcaaaattctgctcatatccgttcctcctgaaaatttattcgttatcatatatctatagacatatttatagttttattattcgcgtatcacatataaaataaaaagccatggaaactgactcaatgtcagtcccatgacttaattatatcatatatccaataacttctgtctaaattttctctaaattctttgtgaactacatcggtaattgaattaccgagcatcagatatatatggcttcgccatacagattctgggtgcgtccatgacacctttactgctacctttttggggttacacagctacttttatgatcaggggagaagataatccggtaacggatatctttttctctttgccgcagccggcaaaatattttctcataatgttatatgcccctactgcatccgcattatatactgacatttggtccttatacaatcccctgttcgttctgttacatttctttgcatattcttttgttacctgtggtgcatgtggggaacactggcttgaatattcttctgtctgtttcacaagtgtaattccatgcattgcaagtttatactccagcattccatatatttttgcataaggcagtgcatgaagtttttgatttgtcacttttcccagattcttattccttcgaatatttgtgatatcaccaataataaccgtatggatatcatttgctttacaataatccactactgctctggtcactttatgaagatagtcgtgaatacagtttcgctttttcttatataccttaagcatatgtttggatggcttcggatacttaatccctcctgctgactgacagctgttccattgatgcccaagtcttgcgatttctttatcatatttccgggagatttccagatattttcttccaaggataaaacttgtccccgcagaatcataacaggtcatcagattgtgaagacccagatcaatcgataaatagtgtccgttatcctgcattttttccacatcttttacgtcataaatcacgataacctgacacacatttttctgatccggtggatatatcttaatctgtttgatgacatccgtgttctggaaaatcttattttccagatacagatagttgtcacagatgtcatatgcatgcttcagatactcctttagctgcttcggaagtgataatcgtacccttttgcttccagatacatgtacaattgcattctgcatataggtaattgtcataccgctttgtttaaatcttggcggctttggattctggatgcctttactttttatcagtgcgtaaaatgacttccatgctttatccaccagcttgcacacttcctgcgccgtctgcgagggcagggatttgaaccacatatttccttttaaccgtgctttctgatcataccagtcagggtaatggaccattccaagctccttgaaattgcggcgttcatagttgcacacgttccagagcttagatgccgcatagcacatatggcctacgatattagactctgttgtattcagttgaatatctgtcttatgtgacagcagcatgttcttttcctccttaataagatttactctgatgttcaatataacgccgtatgttctcttcggacacagaacctatgttttccttcatacacatagtgtaccacatctccaagaagagaacaagtgttctgtttaaaaatttaaaaaaaggagacgttaaagtctccaatgtaacctgtggttacgtgttttcatctgcggcaattgaattaccgaggcttcccgctttttatcctaaaaagcgcgaaaccccacatattgtttagagatatttcttgaggtcctcaaccttatcaagtgcctcccaaggcagcttgatatctgtacgtccgaagtgtccgtatgctgctgtctggcggtagataggtcttctgaggtcaagcatcttgatgattccggccggacgaaggtcgaaattctcccttacgatttcaacgattctgtcatctgcaagctttcctgtgccgaatgtatcaaccatgatagatgttggctgtgcaacaccgatagcatatgaaagctgaatctcacacctgtcagcaaatcctgctgctacaaggttctttgctacgtaacgtgctgcgtatgctgctgaacggtctacctttgtacagtcctttcctgagaaagctccgccgccgtgacgtgcatatccaccgtaggtgtctacgataatcttacgaccggtgagacctgcatctccgtgtggtccacctattacgaaacgtcctgtaggattgataaagaactttgtctcatcgtcaatcatatcctttggaagaattggatcaaatacatatttcttgatgtcctcatggatctgctcctgggtaacatcctcgtcgtgctgtgttgaaagtacaactgcctcaagtcttaccggctttcctgcctcatcatactctactgaaacctgtgtctttccgtccggacgaaggtatgtaagtgtgccgtcttttctaacctttgtgagctggaatgcaagcttgtgagcgagtgcgattgggtatggcatgtactcctcagtctcatttgtagcatatccaaacatcattccctgatctccggctccggtatcgaggttgtctgtaaggtcgccctcttttgcctcgagtgccttgtcaactcccatggcgatatcagcagactgcttgtcgattgaaaccattactgcacatgagtttccgtcgagtcccttctttccgtcatcatatccgatctcaagtgctgtttttctgacgattgcaggaatatcaagctgtgcctttgtggtaatctctcctgttacaaggatgaagcctgtacagcttgctgtctcacatgcgacacggctcatcgggtcctgctgtatgcatgcatcaaggatggcatctgatactgcatcgcagagcttatccggatgtccctcagttactgattctgatgtaaataataatttctccattaattatctgttgctcctttcatactgtgttaccaatatttttccaataaaaaaccacttactgcaaataagtggattaaaattaagataataaaaatcctcttattgttcgattactcgctcaggttggcaccttcctgttttctaacggggttgccgtgacttcatagatcctttgtatctccatcactctgaataagagaagttacaatatagaatttttcaaatctctgtcagctatattactaccacatgatatatatgtcaagtatcattttcgatacagatttatcaataatccattttcgataccctattcattatttataagctattttatgcaattattctttcttcctttattgactttcataatttttgtaattatacttaaatttgtatttatagtactaaacacacaatatcaaaataaatttttggagtaactcatgattaaaatcagcataaaagatgcgcagattggtatggtggcagcagaaccgataaagacccctctggggcagatacttgcactgcccggcacaccactcacccgtcagctcatcaacaaaatgaagctatataaggtaggcagcatctcaattcaaaacccattcgatgcagcagcaccgcaagccggcgaaaatacagcaaagcgagacaaggtaaaacctgtacccaaaacccgcgcacatgagatggtgaccaacatccagcgtgttcaggcctcagaagagttcctaggcttccagctcaaatacctcacatgcataaatcaaatcaaggatacttttggcaaaatctgtgccggtgaaaaatcctttgatgaggctgcgcttcttactgctgtcattgacctttcctcatcgtgcggcactacaatcgaaacctttgacatgctctacaacatgcgcaccattgcagacccgttgtactcacactgtctgaatgtagggcttattacaaggatgatcggacgatggcttcatatggaaaagacagatgtgaatacgcttactatcgcaggagtacttcatgatatcggtaaatgcaaaattcccgatgatgtgctaaacaagcctgacaagctcacagatgaagaatttgcgctcataaaaaagcacccacagtttggttttgatttgattagggatctgcagattgactccagaataaagcgcacagccctcatgcatcatgagcgctgtgatggttcaggctatccttcacagcttgacagctcactgattgacgactttgccatgataacagccatcgccgatgtatatgatgccatgactgctgccagacgctatcgcgcaccactttgtccgttcgctgtcatatcaagctttgagagtgaaggttttacaaagtacaatacaaagttcctgcttttgtttttgaaaaagcttgctacaacataccagagcaaccgtgtaatgctcaacgacagccggttctgtaatattgtgatgctcaacccacatgaactgtcacgccctattgtacgttttgatgacggcagtatacttgatttgtccacaaaccgcgagtttttcatcaaatctgtgatgtaagccgatttataatcaaaagggttacggaatagttactcaaaaaaattataaaataaccaaaaataagaaccgtgcatctacagtaagatgctgccggttcttattttatatattgcatttatattgtgtttacatttcatgctttacgtatatatctattacgataccttgagtatgaacttctgaagctccttctcatcctctaccctggcaatctttgcgccaatctttgtaagcttctcctcgagtgcctcatagcctctctggatatagtagatatcatcaaccactgtgatgccctctgctgcaagacctgctataaccagtgcagctcctgctcttaggtcaggtgcattcactctggcacctgtgtatcttttcacgccgctgatgattgctatattgctctctacctttatatcagctcccattctggtgagctcgtcaacatacttgaaacgattctcaaatatgctctctgtcactgtactggtgccctcagcgatacccaaaagcactgccatctgtggctgcatatctgtcgggaagcccggatatggaagtgtggtgacctgtgtatgctttaaatgtccgtctgatattactctgactgagtcatcaaactcctctacctggcagcctacctccaacagctttgctgtggtggcctcaagatgctttggaatgacattctttaccagcacgttgcctcctgctgccgcaactgcaaacatgaatgtaccggcttcaatctgatccggaatgacagaatactctgtagcatgtaatttctccacacctacaattctgatgacatcggttcctgcgcccctgatatttgctcccatgctgtttaagaagtttgccacgtcaacgacatgaggctccttagccgcattctcgataacagtcttgccatctgccatggctgcagccatcataatattgattgtggcacctacagaaaccttatccatatatatgtgtgtgcccttaagctcctttgccctggcgatgacaaggccatgagctatgtctatgtctgctcccatggagcggaagcccttcatatgaaggtcaatcggcctgcttccgatatcacagcctcccggaagcgcaacctctgcatgcttgtattttccaagtaatgcaccaattaaataatatgatgccctgattcgtctgatgaattcattatcgacatttacgcccctgataaatgaaccgtttatctttaccttgtgtatatccacgcgctccacatgtgcgccgatttcttcgattgcctgaagtaagacattgatatcccttacatttggcaaattatctattgttacagtctcgtctgtcattatggcagcggccaaaatagcaagtgcagcatttttagctccaccaatttcaacttcaccgtataaaggatttccacctttgattacgtactgttccatattccacctctatgaattcaggagtatacttcctcctaatatactattctcaatttacactattgttatacatccaactacaaatttcatttatgacgacgtatttaagccgccatttgtgccggtgctgcttttaataaatgacgcagcagctactattatctaatcatatcacgataaataagcactataattcaagtgcctccaccagcttctctactgtctgctccacatcaagcccctcctcggaaacctcgatgtctgcatactgctcatacaattttgagcgctcttcaaaaagggtttctaaagtctgccctttctttaatactacacctctaccctttatgtctgcaagtcgtttttccaaaatagcataagaaaccttgagatacacaactctgcctatctccttaagatgctccatggcttcttttccgtataccaccgaaccgcctgtagctataatggccctatcagccctgatagaggcattgacacggttctctacctctataaaaccgtccgtgcccttttcctcaattatctcacgcagaagctttccctcctgctcctgtatcagtaaatccgcatccaggaagctgtatcccagcacctttgcaagtattacgcctatggtactctttccaactccaggcatgcctataagtacgatattagttttctgttccatctactgcctcagtattctctgtatctgtactattggtgctttctgactgctgtgtgctctctgttgcacttgtatctgctgcctttttgtccttcttggtagtagtaaaataattgtgaatcttgatcttgtcaagctgcttctgctttacagaccatttttcatcgtcctgccatcctgaaaggatgccattgtaatatttgtcctctttattgccctttacagtcttcctgtttgactctgttgctttatcatcggtctttttgtcgagccttacgatatagtaagtgctgtctgtggtgatgaggtctgaggtctgtccctcctcaagggaattgagtgcatctacaacgctctgatcaagattgtttgtagtgtatacactgtcctttgtcttgctgtccgatgactttgagctctctttagactctgtgtcatctgatttcttatctgaatcatctgtcttctccgcatccggatcaacgtatgtggcgtatgtgcctgttgtggctgtagtgcctgctgccttggctgcatcctctaaggatgatccgcctgcaagcgcctctaccactgcatctgcctgtgcctttatctgtgctgactgctcatctgtatatgtctgatactggtaattagagtcatatgcacccttgtaatcaagcttcacaatggtgtatgcagccatattggcttcctcatccgtcacgcttgaatcagcatttttgatgattgcagcatacatcttactctttatgaggcgaagctctaaatattcctcgacaatctcctctgtagcactcatctcgtctatcacatcatcggaatttgccttcataaacttctctgcggcctttttgatttcctttttctcatcatcagaaacctctatatcgtaatctgactgatgcgcctttaatgtgtaaagctcatgagcctcctcgatagcatttttcttccatgtttcaagcacagtattattgcctgatactgtcttgtcccagtagccctcgcccatgtactgtatatacatgtcatcataaccggcctcctggtaccttatcataaaattaacaagcccaagcttgatatcctctttatctaatgtcgcaactgttgcggttttatttattgcacatcctgtaaaagctgtaactgagagtgttgcagctaataacatggctattacttttttcgctttcattgtatctatcctctttaaaattggtatagtatcgctcgtatattatagagcttttcgggcctgctggcaagcattttctaaactttgtaaattatcgtcaatttcgcgtaaagcatgtggtgtttcctatgctatatgctacatgattccaaaattcgggtaactattcagccgtaatcagttccttacgcatttgcgaaatcagttcctccaccacatcaagcacatcccgcttctttgccacgctgccattttttaaatcaaatgtgaaatatgggttttctgccatattgaatttgagggaagatttatactgggcaacaagcattggtatcttctccggatttatccttgcccgttcaaacatggtaagctttatcagtgagccggtctgctttatctcagtgatatatacggcatgtgccaacgccttgagccttgccacgcgaagcaggctgagcactgattttggtggttcaccaaacctgtctatgagctcctcgagcatctcgtccttctcttcctctgtctctatgcctgcaatacgcttgtatatatccagcttctggaattcgtttgcaatataacctgccggaatataagcatcggtcacgatatccaccgtcgtatcaaatttatcactgatatcctcgatgccctttgcctcttttacagcctcgctcaacatcttgcagtacaaatcgtagcccactgcctccatgtgtccgctctgctccgcaccgagcagattgcccgcaccgcggatttcaaggtctctcatggcaatcttaaagccgctgccaaggtctgagtactcctttatcgctgcaagacgcttttctgccacctcttttagcatcttgttgcgcctgtacatgagaaatgcatacgcagtacggttagatctgccgactcgtccgcggagctgataaagctgtgaaagtcccatgttgtccgcatcgtgtataatcattgtattgacgtttgagatatcaagtccggtctctataatggtcgtggatacaagcacatctatttcaccattgatgaaacggtacatgatgcgctcaagctccgtctccttcatctgtccgtgcgcaaatgcaacagtcgcatccggcaccagctcctgcagctttgctgttatgtctgctatgtcgcgcaccttattgtacacatagtacacctgtccgtttctggcaagctccctgttaattgcctctctgacaagctcatcattgtactccatgacatatgtctgaatcggtacacggtccatcggcggctcctcaagcacgctcatatcccttatgccgattaaactcatgtggagtgtcctcggaatcggtgtagcggtcagtgtgagcacatcgacattgaccttcatctgcttaattttctccttgtgagtcactccgaagcgctgctcctcatcgattaccaaaagccccagatccttaaactgcacatcctttgagagtatgcggtgtgttccgataatgatatcaacctcaccctttttgagcttttctatcgtctttttctgctctgctgcacttctgaaacggcacatcaaatccacattcaccggaaaatccttcatcctctgcgaaaacgtatcgtaaatctgctgtgccagaatggttgtcggagcaagatatgccacctgcttgctgtcctgcaccgccttgaaggccgcacggattgcaacctccgtcttgccgtagcccacgtcaccgcaaatcagtctgtccattattttatggctctgcatatcagtctttgtggcttctattgcaagaatctgatcctcagtctcatcaaatgggaaaagctcctcaaactctctctgccacaccgtatcctcgccgaaggcatagccgttttgctgctcacgctgggcatacagcttcaccaggtctcctgcaatctgctttactgcacctctgacacggttctttgtcctggtccattcctgaccgccaagcttgttgagctttggttttctggcatcctttccggcatatttttgtatcatatcaagctgagtggcaagaatatagagattggagccaccctgatactctatcttgatgtagtcctttacctttttgtccacctcaagcttttcaatgccgcggtaaatgccgagtccatggttttcatgcaccacatagtcccccaccgacaaatcggtaaagctctgtattttctcaccctcataggtgcgatgacgcttctttttcttctgctgcgccccaaaaatatctgactccgtaatcacggcaaactttaggataggatactcaaagcctcttctcaccttgccgtagcagaccataatctgcccctctgaaagctcatggtcgtagttttcagtgtaaaagcatgtgattccctgatctgtgatatcctctgaaagccgctttgccctcgtccttgaaccggataaaagaatgactctgtagccgtttttcttatagcgctttaagtcctttatcaaaagctcaaagctgttattatatgggctgacactctgacagtgaataccatagcttcccagctggtgcagtccgtttgctttattatcaagcgcagcgagtgcgatgcacgaatacttcccaagctttgccacaatctccttttctgtaaaaagaccgttcatctgccccggaagtatatatcccatcgcaagtctctgcttcatgctctctgaaaactcggtctcggtaagctttccctgctctacgcacctggtcagctcatcgaaaaatataaggctgtccgatggattaaaataatccaaaatcccgactctctcgtcaaaaaagtacgacaaaaaagcatccatgcccgcatacatggacagctctccccactcctcggtaagctcgtctgccatcacagtcactctgtgtgcttcctctgtcttcatctgctttctaagcttgtcagacacacgctttgcctctgccttaagcttgtcaattcccccggccttttcctcatcgctaagtacaagctctgccgccggatatatgctcacccggtcaatattttcaatggatttctggctctcgcagtcaaaatatctgatggtgtctatctcgtctccccacagctcaattcggataggattctcctccgtcagtggaaaaacatcaagaataccgcccctgacagaaaactgtcccatagtctggacctgatactccttttcatagcccattctgataagagcagcctgaatttccttcaaatccaaaagctgtccctgctcaagtgtaagcacgttttcccacatcttttctatcggcgccatcgtattcatcagcgcatcaaaggtggtcacaagtgtcacactctcctgctcacggatagccttcaaagccctgatgcgctccgctgtcaggagattgcccctgatatccgactggtaaaaaagcacatcctttgatggataatacaccacctctttgtcaaaaaaactgtactcatcgtacagttccttcgccttctgctctccaaaggtcacaataagcttgtttttcctgtgacctccaaaggcatatatcatctgtgatttttgcgcatctatgcatcccgtgacagatataagtccggacgatttttctgccgtttttgtcatctcctcaaagcccgcaagggaaaggagtggctctgtaaatgctttcactttcaattctccatttctgtctgttcaaaatcaccttgtcgatttccagctagttatatatgttcatagccttatccgtctcgccctgcatcataagaactgctgcatccatcgcatgaccgatagcttcctccacctttgccctgtcctcagaactgaaacgcccgagcacatggtcagccagatcccagccctgcggcttctctccaacaccgaccttgatacggctgaagccctgtgtgccggtcattgcaatgatgctcttgatgccattgtgaccgccggcgctgccctttttgcggatgcggatacgccccggctcgagcaaaatatcatcaaaaataacaatcatttcctcatccggatcaagcttataaaaattcatcacctcagcaacagactcaccgcttaagttcatgtatgtctgtggcttcacgagcagcaccttcatgccctcaatcactccactgccacagagcgccttgtgctttttgtctgtcacacttatattatatttatccgcaagcgcatctatcacatcaaatccgatattgtgtcttgtgtgctcatattttttgtcaggatttccaagtcctactataacgtacatcgtttatcctttctctttctcatatcatttacaattcaaaataaaacaaatactgctggataattcccgccacacccttgtagcgttcaaaatcaaagccgtcactataatatttgtccaaaagctgctttacatgcgtatctatcggaaacgcatccacatgatgcaaaccaaaaagacatatgcagttcgccacctttttgccaattcctttgcgggtaagcaggctttccatcgcctcatcatagctcattttgcgcagattatcaagccagtcaggattattagcaccatactcatatatttccttcagatacggtgccctatagccaaagcccatgctcctgtcatcaaatacctcctccggcacctcaagcggctttggaaatgtatacagctcttcaccctctgcactgccgtctattttatgcccgcaccgcctgcaaagtaaatccacactgtttgtgattcgcttaatgttattattctgggaaatcataaaagtaacaatcatctcccacaaatcctgccttaaaatgcgcacaccactgccatatgcatacgcctccttcagatgcgcatcatctccgtctgctataagttttgcaatccctgcataatccgtatccatatccagatagcttttccatatattgttccagtctgcctcatcacagtccagctcaaactcattcccatcctgcttaatccgaagcgccctgtcaaatgccactactgtatattcattttctcctgtattcttccatctaaagcactgaccactgtcagcaatctgttttaaatccagattatctattttcgtcttgtacatatcgtttgtctatcctcttttattgtagctatactctaaaaagccggtctttctgtggcttattgtaccacggatagaccggtttgtgtgaaatatatttggattattataccagctcaggaattttatatcctgctttgctcatcgctttttcaaagttattgtttgattttatgcattctcaatctctgtcttatacttttcaagaatcatattctggatattctcgcgtgtggcagagttaatcggatgggctatatccctgtactcgccatcgtttgccttgcggcttggcatggcgatgaaaagtcccttttctccttcgattaccttgatgtcatgtaccacgaattcatcatcgattgttattgacacaaccgccttcatcttgccctctttttctaccttacgaattctgatgtctgtaatctgcatatttttttccccctggtctgtttttaaattacatatcttacatttttttcttttactatcatgactccatcctcaccacaatagcaggtgtttggattgatggttccacggctctctacgatgcaattttcgaggtgcacattgtcgcctatgtagacgtcattgagcagcacgcagttcttcacggtagtgtttttgcccacaaatacctgcttgaaaagcaccgaatcctccacgctgccgtttatgatacagccacttgatacgaggctgtttgaaatgtctgagccaggattaaacttggccggtggaaggtcgtccacctttgagcagatggtcggctcctccctgaagaaatagcttctgatgtcaggtcttaagaaatccatattggtcttgaagtatgcatcaatatcggcgatattgttccagtatgaatttatcttgtagccatatattttctttacatttttgtagcgcacgaggatatcatttacgaaatcgaatctgttttcctcagctgccgcctccaaaagctctatgagctgtcgtctcctgatgacatagatacctgtggaaatggtgttggatgaggcctcgattggcttttcatcaaactctgtgattcttgactcatcatccatgcgtaccacaccaaaacggctgacatcgtcgttgtacatcatgtccttgcataccactgtaatgtctgattttttctcgatgtgaaaatcaagcactctgttgaaatccagcttgtatacacagtcaccgctgctgatgatgacatatggctcatggcgtctcttgagaaaatcaatgttctgatacatcgcatctgccgtgcccctgtaccagtcactgttgtccgctgtgactgtaggtgtaaagaggaataagcccccctgctttctgccaaaattccaccattttgatgagcttaaatgctcattcagtgagcgtgcattgtactgggtcagtactgcgacagtctgtatatgtgagtttgacatactgctgagcgcaaaatctatgcttctgaagctgcctgctaccggcagggccggtactgctcgttttgctgtcagttccttcatcctattattgttgccgccggccaaaattattcctattgccttcattttccgtcacctgccttgataataacttctccgccctcaagcacaccgtctttgtagtcctcttcgtatgtaacaccggagattgctgtatttttgcctatctttaccccgtccggtatcacagaatcttctcctatagtgaccagcccaaatgagtatatgctctcatttaatacgttcggcttctcctgtccgaagccaagtgtcacattgtcgcccaccttgcaattttcggcaatgatggacttgtctatcgtgacattggagcctatctccgtgtcacacatgatgatggaatcacgtattactgcgcctcttccaatcttgacgttggcacctatgacagaatgctccacatgaccgtagcattcacagccctcacccatgatgcttcgctccacatggcctcctttggctatataaagtggctcgattgcatcattctttgtgtaaatcttccaatactcctcgtacagattgaactccggaatgaggtccacaagctccatattggcctcccagtatgagcccagtgtacctacgtccttccagtatccgttgaactcgtatgcaaacatacgtctgtcgttttcaaagcagtatggtatgacatgcttgccaaaatcacagttttcctgatcctttagtgcaagtaatgcttcctttagcaccggccatgagaatatgtaaatgcccattgatgcgagattactgcgcggatgaaccggcttttcctcaaatgcattgatgcgcttatcatcatcggctatgacgataccaaatcggctggcctcctcgataggcaccggcatggttgctatggtcacatcggcattgttttccttgtggaaatcaagcatcacctcatagtccatcttgtaaatatggtctcctgacagtatcaacacatagtccgggttgtaactgtctatatacctcatattctggtagattgcattggctgtacctgtgtaccactcgctgttgccgctcttctcataaggaggcagtattgccactcctccattattcctgtcgaggtcccacggaatacctattccgatgtggctgttaagtctgagtggctgatactgtgtaagtacacccactgtatcaatgcctgaattgatgcagttgctaagcggaaaatctatgattctgtactttccaccaaacgaaactgccggttttgctacgttcgctgtcagaacaccaagtctgctgccttgaccgcctgctaaaagcatggctatcatttctttcttaatcacgttatcactcctcgtctgtcctaatttttgttgtgcccatccggtccccaccacttgtttctgtaataaccgtatctgtaatgcttccataataaatcacaattgtttccatataaattatagttgctgctgcataaattgcagttactgccatatactttaaccccatcaaattcatatggtccggatgaattatttttataaaaaaattataccacagccgcattaccacttcaacatttttcacaaaatcaaataatatttttcttttttttcgacattttgcacaagtgccatttatcgtatatctgtttaacctgctatggttcttatcatttgaaagtcatgcctgctttcaccttatttttcctttgcaaatactatatttagttgtataattaatataaagtaactattcagaacaagaaaatctgttgcttacatgcaatcatgacgcatcggctttttgttctcagtgtttcttaatagttaaaatataaattataataaatcaggcaggtaaaattaatgtataaaatagatttcagcaaaccaatacacatccatttcataggcatcggcggtatcagcatgagcggtctcgcagagattctgcatgaggagggctttacaatttccggctccgattcaaaggaatcagacctcacaaaaactctcgctgccaagggcataaaagtcatatatggccagagcgcagacaatatcacctccggtatcgacctggtggtttacactgcagctatccacgaaagcaatcctgagtttgccgcagcaaagacagccggtattccaatgcttaccagagccgagcttctcggacagattatggacaattacgattattctatcgctgtagccggtacacacggcaagactaccaccacatccatgatcagcgagattcttctcgccgctcagacagatcctaccatttccgtaggaggtattttgtcatctatccacggcaatctgcgtgtgggcgattcagagtacttcatctctgaggcgtgtgagtacacaaacagctttttgaatttcagaccacgctacagcattattttaaatattgaggctgagcatctggatttcttcaaggatatcaacgacatcaggcattccttccgcgagtatgcatcaaacactctcgcaggcggtgctaccatcatcaatggtgagattgaccgctatgaggagattgtcgcagggcttcctcagaagattatcacctatggctttgattcaaaatatgatttctatccggaaaatataacctatgacgataaagcttgtgcatcttttacagctatgagacagggtagtccacttttcgacgtaaaactctctgttcctggcgctcacaatgtaagcaatgcgctcgcagccatagctttatccaccacactcggtctcgatacggagtctatcctcacaggccttgacaaatttggcggtgctgacagacgtttccagtacaagggcaaggtaaacggcgtcacaatcattgatgactacgctcaccatccaaccgagatccgcgcaacactgacagctgcacaaaaatatccacatgacaggcttgtactttgcttccagccacacacctattccagaaccaaggcattcttaaatgattttgccgatgttctttcaatggcagatgttgtggtgcttgctgatatctatgctgcgcgtgagcagaacacatatggtatctcatctaaggatatcctggatttattgctcgaaaaaggtgtgaatgcgcactatttcccatcatttgaggaaatcgagaaatttttatcagaaaattgtgtaaacggtgacctgttgataacaatgggtgccggaaatgtagtagaaatcggcgaagacctgcttaagaaataagttatccacgttatccacatacaaaatgttaacaactctcattttgtgtgtggattttttaaataattttcaacagcttatataccctgtgatacattgatttttcaattattttacacagttatccacgttatccacatttttttgtggactcgaaaagcccgagtttacaaggcttgtagcacttttaccatcttcacacggttaaaatattgtgctataattgctcacaggttaagcgaaagagagttttttatatgacagcgataaacattagcagtgacatagcaacatcattcactactgtgtcagatatttttatagatcaatacatgccaaaggcaaacggtgagtttgtcaaggtatacctttatctgctccgtgcgacaggctccggggcaggcatagcaactatttcagagattgctgatcatttcagcaatactgaagccgacatcatacgtgccctcaattactgggcctctgagggcattttacagctgcaatccggcgctgatggtcagattatgggaatcaacctctgcagtctttctgtatccggtgtgcaggatgctcagagtaatatacaaagcgctgtggctgataatgccgcgcagaataatttgcaaaacagcgtggttaataatggtgcacagaatagtttgcaaaacggtgttgttaataacgttgcgcaaaatatttctaccgcgaatattcggatgcaggattctgttgtggaaaagcttaagagccagactcctgacaagcctgcttcttcacagaaggaatacacacttgatgagattaaggagtttagaaagaatcctgacatttcagagcttttctttattatagagacatatctgaagcatacgctctcatccacagacaccaatatggtgctctactggctggacgagcttcatttttctaccgacctggtagaatatctcgtggagtactgcattaccaagggacattcaagccttcgttacatgaacaaggtcgctctcggctgggccgatgccggcataaagaccgtagaccaggccaaggacgatgcagccgctcactcacagatttactattctgtaatgaaggctctaggcatcacaggccgcaatctggttgactctgaggtgtcactcatcaataaatgggtcggcgaatacggtttcgatatagagcttgtaaaagccgcctgcagtaaaactatttcagctatccagaagccaagcttcgagtacacagactcgatactcgcgaactggaggaaaaaggatgtacatacattaaaggatgttgaagtgcttgatgccaactttgcaaaggccaataaagcctctgctacaggctcatcacaaggcacaaatgctgcaaactgttcctcaaaaccaaaaagcaataattcaagttccaagaataaatttaacaacttcaatcagcgcaacaatgattacgacaagctggagaagctgtttctgaattctacggtatgatttttcaagttagatttacacatcccaaggaggatatatggcacttaccaatgctcaatatgatgagataatgcgaggctacgataaacgccagcttcagaacaaatacatacatgacaagcgtattgaggaagcctatcgcaaggcgccccgcctcagggaaattgactcagagattgcatccgcatctgtcaggcaggcgtacaggctcatggatggtgatgagaatgctctcgccgctttacgccttgcaatcgaggactataaggaggagcgtgctgcactgctatccacactcggatatccgcttgattattttgagcctatttacacctgtccagattgccacgatacaggatacatagacggtcagaaatgtcattgtttcaagcaggctattatcaataccgtttattcgcagtccaatatcagggagattttgtctcgtgagaatttttccacgctctcatttgattattactcagatgagcagaagaatcctgcgacagggctgtctgctcttgccacagcaaagcttgcagtgacgaactgtcatgaatttatagacaattttgaaaacaaacctaaaaatatatttttctacggtaataccggtgtcggaaagacttttttatctaattgcattgcaaaagagcttttagatgcaggctactccgtaatttactttacagcattccaattatttgatatattaagcaaaggtgtgtttgaaaaggatgcagatgccatcgcagcgcaccagaatatattcgactgtgatttacttatcatagacgatctcggaaccgagctttccaactcatttaccacatcacagcttttcctttgtgtaaatgagcgtatactgcgacagaaatctactattatttccactaatctgaatttggagcagatagcagagatttactccgagagaacactttcaagaatttcaagcaattatagttttatcaagctcttcggagatgacatacgaattaaaaagcgtctttccaaatagcgctttttatattatatatttagtttatttattatatggttatatggaggaataacaatgccaaacgatgagagaattttggagactatgccaaccggtacacttggacttgttgcaaccgacagttgtataggtcttgcccagaaggtagatgcatacttacagggctggagagagcacagagagcaccagcatgctaacgagagtgctttcaaggactactacaaaaacagctacattatcaagccttctacacctagattcggttccggcgaggctaaatgtgttatcaaccagtcagttcgtggttatgatctgtacatcatggtagatgtaacaaactacagtcttacctatacagtatgcggtcagacaaaccacatgtcacctgatgaccactacgcagacttaaagcgtgttatcgctgcagccggcggaaaagcaagaagaatcacagttatcatgcctttcctttatgagagccgtcagcacagacgtacaggccgtgagtctcttgactgtccattggctcttcaggagcttatcaacatgggtgtagacaatatcatcaccttcgatgctcatgaccctcgtgtggtaaatgctattcctctgaacggctttgagaatgtaatgccttcttaccagttcattaagggcattttaaagaacgtaaaggatatcactattgatgctgaccatcttatgattatctctcctgatgagggcgctacaaaccgtgctatctaccttgcaaacgtactcggagtagacatgggtatgttctacaaacgtcgtgattacagccgtatcgttgacggacgtaaccctatcgtagctcatgagttcctcggaacaaatgtggagggtaaggatgttcttatcatcgatgatatgatttcttccggcgagagtatgatagatacagcaagagagctcaagaagcgtaaagctaacagaatctttgttgtttctacattcggtctctttacaaacggctttgcttcatttgacaaggcttacgaggagggtctcatctacagagtagttacaacaaaccttatctaccagtcaccggagcttctctctaaggagtactatatcagctgtgacatgagcaaatacatcgcatacctcattgatacattaaaccacgactgttctatcagtgatcttctctcaccatatgacagaatcaagaagtgtgttcagaagtacaatgacgagcaggctgcagcaaaaaataaataattaagtgcatttataaaaagccgtgtgaaatgatatgtaccccttttactggacatccagtgaaaggggtatttttatgcgttacagttacgaattcaaacgaaaggctgtcgaactatacatgcaagtaagacgcatcagtttttctcaaagtttagaataattatcttagtaatataaaaaaccagagaagtgagtgtcatccactcaaatctctggtttaatttagtctaagatttataccgattaaatattaaactaactcaaggagaacctctaaagctccgtcacctttacgctgtccaatcttaacgattcttgtgtaaccaccgttacgatcagcatacttaggagcgatctcatcgaataacttgtttgttacatcgatagtctttgttcccttctttgtgccgtcagactctttagctgtgtaaagaaccttaagcatctgtcttctggcatgaagacgtgaagcagaatccttcttgatcttcttctctacttcgtcataaacagtaactttctttccgtctacaacctcttttactctcttgccatctttgtccttgcgggcaaccttagctgttacagtaacctcttcgaagttgtctttctcttttactgctaatgcgataagaccctcagcgatcttacgaacctctttagccttagcctctgtagtaacgatctttccgttaacaagaagctgtgtaacctgacctctgagtaaagcctttctctggcttgatgttctgcttaacttacgatattttgccattttaatttcctccatttgtgggacatccggtcacgctcttcggtcttactgccagacatcgtatcttgttgtgataaagctttgccttatttcaaaaagcaaatgctcaaatcagttgccactcatgtatcagacacggtcacgctctttggtcttactggccctgccgctatgagttttgtcacacataaacataaatatgatatttaaaatttatatatgaccaatttatttagaagaatcagtgcaaggattattcgaatgaattattcctcagtctgatttaactctaaacctaattcttttaattttgctaaaacttcctctaaagacttgcgaccaaggttacgaaccttcatcatgtcctcaggtgttctattgataagctctgcaacagtgttgattcctgcacgctttaagcagttgtatgaacgaactgaaagctcaagctcatcgatgttcatctcaagaaccttctcctgagcatcgttttccttctcgaccataacgtcaacctgctgtgctgcctctgaaagatcgatgaacagatttaagtgctcacttaacaccttagctgcaaggctgactgcctcgtccggctccaatgtaccatttgtaaatacatctaatgtaagcttatcgtaatctgtaacctgacctacacgggtattctctacagtaaggttaacacgctcaacaggagtgtagattgaatctacagcaagaactccgattggtgtatcctcgttcttgttcttctctgctccgacataacctctgccgtttgtgattgtaagctccatgtaaagcttagaatctgcaccaccattcaagtgtgcaatctctaactcaggattcaaaatctcgatatctgaatcaacctgaatatcggctgctgtaacaacgccttcaccttcgaattcgatatatgcaacctttggttcatttgtagaactattattgcgaattgcaaggttcttgatattcatgatgatttctgtaacatcttccttaacaccaggaatagagctgaattcatgtaaaacaccatcaatcttgacctggcttactgcagcgcccggtaaagaagaaagcatgatacgtcttaaagagtttccaagtgttgtaccgtaacctctctctaatggctctacaacaaatctgccatatgtcttgtcttctgaaatttctgcgatttcaatttttggtttttcaaaatcgaacacttcaaattccctccttctcgggtatcgttgttatatgttatcaaagagtggataagccgggaaataaatccccggcaaatcaacctaattttacttagaatataactcgacgatgagcatctcatctacaggaacatcaatctgctcacgtgtaggtaagtcttttacagttccctgtaatttctcagcatctacgtctaaccactccggaacgattcttccgccagctacctcgacgatatctttcattctctgagtattctttttgctctctttaatttcgataacatcgccagcctttacaaggtatgaagggatgttaacaacttttccgtttactgtaacgaacttgtgatcaacgatctgtctagcttcttttcttgttcttgcgaaaccaagacggaagattacgttgtcaattcttgactcaaggattgtcataaggttaagacctgttaatcctttcatctgatctgctttcttgtagtagttacggaaaggcttctctaaaacaccatagatgaatttagctttctgcttttctcttaactgaagtccgtactcagacacctttctgtttgctcttgtaaggtttcttctagacttcttatcatatcctaaataacttggctctaaaccaagtgatctgcatctcttaagtacaggtactttattaactgccattttaatctatacctcctgattagactcttctacgttttggtggacgacatccattgtgaggtaccggagtaacgtctctgattgatgtaacctcaagaccacatgctgaaagggcacggatagctgcctctcttcctgaacctggtcccttaacgaatacgtcaactgtctttaatccatggattaaagctgcctttgtagctgtttctgctgccatctgtgcagcatatggagtagatttctttgaacctctaaatccaagaccaccggcacttgcccatgataaagcatttccttcagcatctgttaaagtaacgattgtgttattgaaagatgcctgaatatgtgcctgtccgcgttcaacgtttttctttacacgctttttagttgttttctttgcaacattcttagccatatttaaactaacctactttctactttctaaactttatttaagttataatgaagctctgcttcttcgtccgcagaactaaacgcgcactatgttcaagtggcgttttcacttattttccaagtgattatttcttcttgtttgctactgttctcttaggacccttgcgagttcttgcattagtctttgtcttctgaccacgaaccggaagtccctttctatgacggataccacgatagcatccaatttcctgaagtctcttgatatttaaagcgatttctcttcttaaatcaccttcaactgtcattgtctcgtcgataacagcgctgattctcttaacctcgtcatctgtaagatctctaacacgagtgcttggatcaacattagctgcttcaaggatacggtctgcacttactcttccgattccgtagatgtaagttaagccgatttctacacgtttttctcttggtaaatctacacctgcaatacgagccatgtgtgtttacacctccataatttttagttatttactatagtaacgatacatctgcaacttgacgtatactctccgaaacacatatgtatctacagctacggttgcacgtcctgaaatgtgtgtagccatatgcgctcccatatttgcattttgttccatatcactcggtattataatatgaaaccagaatgcctctgtttattatgaacagcgatgataaatatctcgctgcagccgcacataatgatgtgaaaaaaggtttaataaaccaaacgcacaaataacagggtcaaatatttgtactaattaaccctgtctctgcttatgctttggattctcacagataattctgatgcttccttttctcttgataactttgcacttttcgcaaataggtttaactgatgatcttaccttcacagcaaatcctcctttctctataaaagtccttttcaggtacttttccaaaagtgtccagatagcattatacacggacacttaagggaagtcaatatatttttttaaaaaatcatctgtaaaaattacttatctctccagataattctgccctttgtcagatcgtatggtgacatctcaattgttaccttatctcccggtaaaattctgatgaaattcatacgaagctttccactgattgtagctaaaatctggtgtccgttctcaagctctaccttaaaaaacgcatttggtaacttctcaactacaacaccttcaacttcgataacgtctgcttttgacattttgattcctcctgtaaataaatccttgggtttcgttatgattattattagattagctccagaaatccggctgctttttcatcctctgtcagagaaagtatctccggctttccttttgtaataagtatggtattttcatagtgtgccgacaacgataaatcctcagtaaccactgtccattcgtcatccatccacaccacatgcggtgaacctgcattaatcattggctcaaccgccagtgtcatgcctggcttaagtctaagcccttttctaaagccctgtggtctgaagttcggcacttcaggatcctcatgtaaatggcttcctatgccatgacctacaaggtcatatacaactccgtatccaaacgactcggcaagctgctgtatggctcctgaaatatcatacagtctgtttcccgcaactgcattctttattcctgcaaaaaaactgagacgtgttctttctataagaagtcttgcttcctctgaaatctctcctacgcctactgttctggctgcgtctgagtgatatcctttgtagataacaccagcatcaaggctcacgatatcgccctcctgtaagatacgctcatcagtcgggataccatgtacaacctcctcatttactgaaacacatatggaggccggatatccgcaatatcctaagaaagacggctcgcatccataactacgaatcatttcttcgcccagccggtccacatccttagtggacattcccggtttgatttctttaccgagctgctgatgaacggccgccagaatcctgccggcctccctcatcagctctatctcatgctctgatttgatagttacagacattattattcacctaaaatacctacaatggctgaaaaaacttcatccataggctttgttccgtctacagactttaaaatgccctgcttgtcataatactcgataagcggctgtgtctgctcatgatatacagccaagcgcttctgaactgtctcaggcttatcgtcatctctgagtactgtgtcagcgccacatgcatcacatttgccctcaacctttgttggattgaaaacgatatgatatgttgcaccacaattgaggcaggctcttcttccacccatacggttaacaatgttctcatcaggaacatctacatcgatggcataatccatcttctccccaatctttgtgagagcatcatcaagcgcctttgcctgtggaattgttcttggaaaaccgtctaatacaaatccgtttttgcaatcatcctgctgtattctatccataacaaggtcacaggtaagctcatccggaacaagtgctccctgatccatataagtctttgccttcttaccaagctctgttccgttcttgatgtttgcacggaatatatctcctgtagagatatgtggtatagaatattttgcagctatctgttttgcctgtgtacctttaccggcaccaggtgcccctaacatgatgatcttcataaaaattttctccttttatacaaaacttgttgatagcacgaatggagatactgaattcagtatctccaatgtacaattaatcatctaaaaatcctttatagtatcgaactctcatctgtgattcaatttgcttcaatgtctcaataacaactccgacaatgatgatgattgaagttccaccaaaggatacgtctgcgttgaatactccattgaagaatatcggaacaaatgcgataaacgcaagtccaatagctccaataaatacaatgtagtttaatatctgatttaagtaatcgctggttggctttccaggtctgataccgggtataaagccacctgaacgcttcatattgtttgcaatctcaagcggattgaatgtaatgtttgtgtagaaataagcaaatgctataatcaacacaatgtaaacaataagtccgattgaatataccggctcctttggatcacaccagttagactgtgataatccttttaatatcttagagcctattccatttccattgccttttccaaggaagctagcaatgataacaggtgtctgcataagagactgtgcaaagatcaccgggataactccactggtatttacctttagtggaatgcatgtctgctgaccgcccatctgcttgttgcctcttattttactagagtactgtacaggaatcttgcgctgtgcatcctgaagcaatactacaaatactaccattgcagcaattattgctactatgataagacctgcaacaatcgcctttggtatgttcgctgctgaagcaatgaactgtgaccaaagtgtacttaaatcctctggaatacgtgaaataatattgattgtcaatactattgatattccgtttccaacacccttttctgtaatacgctctccaatccacataagtacagctgaacctgctgtaagtgaagtaacgaccataataacagtcaatggtgtcttttctgtaaggtaattttgtctgtaaaaaccaattaccatcatgactgactcaagaaggcctaatgctattgtaagataacgtgttatctcaacaattttctttctgccatcctcgccatcgcgttgcatctcttcaagcttaggtatagcaattgtaagcaactgcataatgattgaagatgtaatgtatggtgtaatattcagcgcaaatactgacatctgtgagaatgatccacctgttatagcatcaacaaagcctaaaccatctgctgatttactgtttaaccaactctgaaatacggagcccttgacaccaggaatcggaagctcgcttccgattctgatgacaataagcatcatgaatgtaaaaaggattctattacggacatcctttattttaaacgcattacggagtgttttaagcattagatcacctctgcttttccaccaagagcttcgattttctcttttgcactagcactgaaagcgttagcctgaactgtaagcttcttagtaagttctccatttccaagaatctttacgccatctctaggattcttaacgattccagcctcgattaatgtctcaactgaaactactgcatcgttatcgaatctctcaagagctgaaagatttataggtacgattgtaagagtgtttctattcttgaaacctctcttaggcaatcttctatataatggcatctgtccaccttcgaaaccaggtcttggagctcctgaacgagccttctgtcccttgtgtcccttaccagcagtcttaccgtttcctgagccgtgtccacgacctcttctgaaattatcactatgaactgaaccctcagccgcttttaaattagataaatccatcacggtacctccttattttattcttaaacttcttctacttttacgtatggtgctactttgcgaacagctccctgtgtagctgcattgtttggtaactctacagttttgcctaacttagtaagaccaagagcctcaatagtcttcttgttcttaggaacagcaccgattgtagatttgattaatgtaactttaactctatctgccattttagcgttcctcctaacctaagatttcttctacagatttaccacgaagctttgcaacatcctcagggcttcttaactgcttaagagcctcgatagtagcaagtactacgttctgcttgttgtttgatcctaaagactttgtacggatattctggataccagcgatctcgcatactgaacgtgcaggaccaccagcgatgataccagtaccttcaggagacttctttaataatacggaagcacctgtatattttcctgttacatcatgtgtaatagaattgttctcgtctaacttaacatttaccatgctcttgatggcgtcctctttacccttacggatagcttcaggaatttctgctgcttttccaagacctgcacctacatggccgttcttgtcaccaacaacaacgagagctgtgaatcgcatgttacgtccacccttaacaacctttgttacacgcttgatgtcaactacctggtcaactaattctaattgactagcgtcaatgatttcacgtttcatgtttgtctcctcctaaaaatctaagccagcttctcttgctgcttcagctaatgctttaacttttcctgcgtaaataaaaccgcctctatcgaagacaacagttgaaatacctttatctaatgctttctttgcgattacagtaccaagctttgctgctgcatctacgttattagtcttctcgagctctgccttgatatccttgtcaagtgttgatgcagaaacgagtgtatttccaactgtatcatcaataatctgagcatacatatggttattacttctgaatacagctaaacgaggacgctgtgctgtaccagcaagatgattacgcattctgttatgtttctttacacgaacttctgttcttgatttcttactaaccattacttgtccactcctttaattattttttaccagtcttaccaactttacgtctaataacctcatcagcatatttgattcccttgcccttatatggctcaggtcttctcttatctctgatctcagctgcgtactggccaactttttctttatcgatacccttaatgatgatcttgttatcctgaacctctgactcaagtccttccggatcctccatctcaaccggatgagaatatcctaagttaagagtaagtttctttccagccttagaagctctgtaaccaacaccgttaacctcaagagtctttgtataaccctcagttacaccaacaaccatgttgtggataagtgttcttgttaacccatgtaaggatttcattttcttcaaatcattaggtcttgtaactactacttcttcaccctctaatttgatatccatctctgatggaagagttctctcaagagtaccctttggaccttttacagtcacatgattattttctgcaatttcaactgttactccagcaggaactgcgattggcattcttcctatacgtgacatgcccgtacctcctatattttgatattaggttaatagttatttagtatttctgaccttgtggtcaggttatactttaagatgttacttgctgtatccctactatacatcatggatgcatcgaatatggatacttaataaattatacttaatataaattaagatctttaggggttaccaaacgaatgctaaaacttcgccaccaacctgaagctttctagcctctttatcagttacgataccctggttagttgaaagaatagcgattccaagtccaccaagtactgaaggaatctcatccttgcctgcgtatacacgaagacccggcttagaaattctcttgatgcctgtaataaccttctcgttcttatcagcaccatattttaatgtaacatggattgtcttgatttttccatcctcaacgatgtcgtatttctcgatgaatccctcatctacaaggattccagcgattgctactttaatcttagaagctgggatgtctactgtatcatgttttgcagtatttgcgttacgaattcttgtaagcatatctgcgattggatcacttgtcatcatcataatgaacgatatcctccttaaatatgtttgttaatatagttatttataaaacagctgttgctgaaaggaagttctcttcgcactaagctcacacagcgcatatgcgcttgtgttcactaagttgctttcaggcttaccagctagcttttttaacgcctgggatctgtcccttgtatgctaactcacggaagcatactctgcagattccgtatttctttaaaactgaatgtggacgtccacaaattctacaacgtgtataagctcttgtagagaactttggtgcacgctgctgtttgattttcatacttgtcttagccattagaattcctccgattatttagcgaatggcatattgaactgtgccagtaactcacgtgcctcttcgtctgtcttagcagtagtaacgaagataatgtccataccacgaaccttatctaccttatcatactcgatctcagggaagatgatctgctctttaattccaagggcatagtttccacggccatcaaatgcgttagggttaacacctctgaagtcacgtacacgaggtaatgctaagttgatgagacgatctgcaaactcgtacatcttctcaccacgtaatgtaaccttacatccgattggcattccttctctgattttaaagttagctatagcattctttgctttagttgtaactgctttctgtcctgtgatggcttccatatccttaacggctgcctcaagaaccttagcgttttccttagcttcaccaacacccatgttaactacgatcttgtcaagctttggaatttccattgcgtttttgtatccgaactttttgatcattgcgtccttgatctcattttcgtactgttctctaagtctactcaatgtcttaatcctcctctctccaattagtcgataaccttgcctgttgatttagcaaagcgaactttcttgtctccatccatcttgaatcctacacgagtaggctttccatcatggatgagcattacgttggaagcatcaattggagcctcctgatgaacgataccgccctgctgatttgacatacttggttttgtatgcttagtaaccatgttgattccctcaacaagaagtgtattgttctttgcgtttacggcaattaccttgccctcattgttgatatcttttccagcgataaccttaacaaggtcgccttttttgattttcatagttgccattgacgttcctcctataatacttccggagccagagaaacaatcttcatgaactgtttctcacgaagctcacgagctactggtccaaatatacgtgttccttttggagttttgtcatctttgatgattactgctgcgttctcatcaaactttatataagatccgtctttacgacgagcaccttttactgaacgaactactacggctttaactacatcgccttttttaacaacaccgcctggtgttgcatctttaacagtagcaacgattacatcaccgatgttcgcatatcttctggtagatccacccataacgcggataacaagtaactctttagcgccagtgttatcagcaaccttgagtctgctttcctgctgtaccatgcttgtagcctccttttattattttgctctttccatgatttctacaagtctccatctcttatctttagataaaggtcttgtttccataactctgactgtatcaccgatctttgcatcgtttttctcgtcatgagcttttaatttataagtcttcttaacgatcttgttgtaaagaggatgtcttacgttatctcttacagctacaacgattgtcttatccatcttatcgcttacaacaacaccaacacgtgtttttctaagatttctttcttccacggtctaaaatctcctttctgataggataaactattctgcagcctttgcagtgataacagtctgaattctagcgatgttcttacgaacctctttgattcttgctgtgttatctaactggttagttgcattctggaatcttaaattgaaaagttcttttttagcatcaacgagctgtgcctgtaactgctctacgctctgtgcctgtaactctttaacgtatgcactagttttcatttgactcaccgccttctaaatctgcacgagaaactactttacacttgcaaggtaatttgtgtgtagcaagacgtaaagcttctttagctacgtcttccggtactccggagatttcaaataatactctacctggttttactacagctacccaatactcaagggcaccctttcctttacccattcgaacacccataggcttatgtgttacaggtttctctgggaaaatctttatccaaactttaccaccacgcttgatgtaacgagtcatagctacacgggcagcctcaatctgatttgctttgatccagcatggctcaagtgctacaataccgtactcaccatttgtgatcttgtttcctcttgtagcttttcctgccatggaaccacggaactgtttacgatgttttactctcttaggcattaacataattacttagctcctccttccttgtttgcttttgtaggaagtacctcgcctttgtagatccaaaccttaacgccaaccttgccgtaagttgtatctgcttcagcgaatccataatcgatatctgctctgattgtctggagtggagtagttccatcattgtatgtctctgtacgagccatatctgctccgccaagacgacctgaacatgttgtcttaattcctttaacgccggccttcatagctcttcccatgcaagacttcattgctctacggaatgaaacacggttctcaagctgtaaagcgatgttctcagcaacaagctgtgcatccttgtccggtctctttacttctttgatatcaacaactaatttcttgtctgtaagcttctgaacctcagccttgatcttctcgatctcagctccgcccttaccgattacaacacccggcttagctgtataaatgataaccttaacgcggtctgaagctctctcgatctcaatctttgaaacaccagctgcgtataattttttctttaaaaatgttctgatattataatcttctactaagtaatcagcgaaatcaccctctgcataccatttggaatcccagtccttgataacgccaactcttaagccatgaggattaaccttctgtcccatgattgcctcctatctttcatcaagcacgattgtaatgtggctcattctcttctcgattctgtaagctctaccctgtgctctaggatgaattctcttcattgttggtcctttatttgcaaaacactctgcaacgtaaaggttctctgccttatagttcttttccggataattattttctgcgttagcgattgctgactctaataatttctttactaagcttgaagcatatctaggattgtatgttacgattgcaagtgcttcgttaacactctttccacgaatagcatctaaaacgaaacaagctttctgtacagacactctagcataagataactttgctgaaggtcttgtatctctaacttcatttctctctctcttgattttggatctatgtccctttgccatggatgaaacctcctttcaataaatcttatcttacgcctgatttcttctcgtcttttccatgtcctctgtaagttcttgttgcaacgaactcaccaagtttatgtccaaccatatcctctgtaacatatacaggaacatgctttcttccatcatgaacagcgattgtgtgtccaacgaatgaagggaagattgttgaacgacgtgaccatgtcttgattacagacttgtcaccagaagcgttcatagcatctacttttttaagtaagctttcatcagcaaatggtcctttttttaatgaacgtgccatttattcaacctcctaattatttgattgcacgaccgtctcttctacgaacgatcatcttgttagactgtttgttcttctttctggtctttaagccaagtgcaggtttgccccatggagtacatggtcctggacgtcctacaggtgccttaccttctccaccaccgtgtggatggtcgttagggttcataacagatccacgaactgttggacgaacgcccatgtgacgcttacgtccggctttaccaatatttacgaggttgtgatctccgtttccaattacaccgattgtagcacggcactgaattggaaccattctcatctctcctgaaggaagacgaagtgttgcatatttgccttctttagccataagctgtgcgctaagtcctgctgaacgaacaagctgtccgccctttccaggaagaagctcgatgttgtgaatctgtgtaccaactgggatattctcaagtggtaagcagtttccaactctaacctcagcctgagcaccgctcataaccttcattccgtctgtaagtcctgctggagcaagaatatatgatttctcaccatctgcatagcagataagtgcgatgtttgctgttctgtttggatcgtactcgataccaattacagttgctggaataccgtctttcttatttctcttgaaatcgataagtctgtattttcttctatttccaccaccctggtgtctaactgtgattttaccctgattgttacgaccagcgttcttctttaaagaagtaacaagtgacttctcaggagttgtctttgtaatctctgagaaatctgaaccagtcatatttcttctggaaggtgtatatgggttatatgtcttaattcccattttgtttctcctttcgatatgttttcattatcgcgtcttttctgacgcatatcattttgaagttgctttcggtctacagtcctgcgaagatctcgatatctttgctgtctgctgtaagctgtacgatagccttctttgtcttagcagtctttcctgttaccattccacgacgcttgttcttgccttcgcagttcattgtgttaactttggcaacctttgttccttcgaacattctctctactgcttctttgatcatagtcttgtttgcatccgggtgaacaaggaatgtgtatttcttctcagccattgcattcatactcttctcagttactactggtttgaggattacatcatagtactgtacgtttgccattatgcatatacctcctcgattgttgctacagcagcctttgtaactactactgtgtcatattttaatacatcgaatacgttaagctcatttgtctgagttgtcttaactgtcgggatgtttgctgcagaagcgataaccttctcgtccatatcatttaatacaacgagtgccttctcaacattgaggttctttaatacttctacaaatttctttgtcttaatctcatcaagcttaagctcatctactacaacgaacttgttctcaacaactcttgatgtaagtgcagacttaagagctgctctcttctctttcttgttgagcttgaatgagtaatctctaggagtaggagcgaatacaactccaccacctgtccactgtggagatcttgtagaaccctgacgtgcatgtcctgttcccttctgtctccatggttttcttccgccaccgcgaacttcagaacgtgtcttagctttctgagttccctgacgtttatttgcaagctgctgaagaacagccatatgaactaaatgctcattaatttctacgccgaaaatggaatcatttaactcgatcttgtcgacttctttgccttccatgttatatacagctacgttagccatcgtaaagttcctcctttcttactttgcactatttaccagattttgtagtctcttttactgtaatgagagctttcttagctcctggaactgcgcccttgattaacagtaagttcttgtctgcgtcaactcttacaacctcaagattctgagttgtaacctttacgctacccatgtgtccaggcattccttttcccttgaataccttacttggtgaagaacaagcaccgttagaaccctgatgacgatggaatttagaaccatgagccattggtcctctgtgctgacctaatctcttgatagcaccctggaaacctttaccttttgaaatagcagttacatcaaccttgtcaccctctgcgaagatgtcagccttgatctcatctgctaaattgtactcatctgcgttttcgaatttgaactcgcgaacgaatctctttcctgaaacacctgcttttttgaagtgtcccatctgagccttgttaacaccatgtctgtgtgctacgctctttttaccgttggcatctttctcaacgactttctctttcttgtcgccaaaaccaacctgaactgcgctgtaaccgtcattctcaacagttttgatctgtgttacaacacatggaccagcctctaatacagttacaggtactaatacaccatctgcattgaagatctgtgtcataccgatttttgttgctaaaatcgctttcttcatttctttacctcctgttttctacagcggaacgcctcttgcctgtcaacccagcccgcgaagaattagccggaacaagtagcggaaccgttcatcctagagcagcctactagatcgttatgctttcgcactgtatcttctatataaaccattcggggatatactaattaattgttgaagcttatttctgcttcattttgatatcaatgtaaacaccagctggcatttcaatccttgataaagactctgttgtcttctgtgttggattgatgatatcgataagtctcttatgagttctctgctcgaactgttcacgagaatccttgtacttgtgagtagctctaagaattgtaactacttccttctttgttggaagaggtaccggtccgctcacctgtgatccattcttctttacagtctcgatgattttctttgcgcttgaatctactaactcgtgatcatacgccttgagagtaattctcattacttgacttgccataaaaaaagtcgcctccttttcgcacttttaacttcagtacgacaagcggtgactgtacacatctccgtgtgtgtcctgtggactttcacacgttgtttctacattttgtagaccatatctgttctgtacagtgacttgccgtcagtttcctaacttgacattcgctccgccgaattctctgtctcatggacagtaacttcaaacttcatagctatcatgccacagcaagtgatattatacatgacgtttccaataattgcaatacttttttcaaaaaaaatttatttttttatttcgggtaatattccattgaaaaattacacttttgcacgtatattattatagaagaaacctgattaaatgcaagcaacgtgtagtttattttttacacgcagataagaaaggaatataaacatatgtggttagcagatagatggaaagattacgaggttattgactgctcatgcggtgaaaagctagagcgttggtctaaatatattttgctgcgtcccgatcctcaggtaatttgggacactccaaagactaataagaactggaaaaagcttaacggtcactatcacagaagcaagaaaggcggcggtgagtgggagttttttgatttgccgcaggagtggaccataaactactctcttcctattaataaagagctcacatttcacttaaaaccattcagcttcaagcacaccggtctgtttcctgagcaggctgccaactgggactggttttcaaagaagatttatgatgcaaaaaaaagcggtcgtgatgtaaaggtattaaatctctttgcatacaccggaggtgccactcttgctgctgctgccgcaggcgctgctgtcacacatgtggacgcttcaaagggcatggtcacatgggctaaggaaaacgctgtaagtagcggtcttggtgacgcacctatcagatggcttgtggatgactgtgtgaagtttgttgagcgtgaaatccgccgtggcaatcattacgacgccatcataatggatccgccgtcatacggcagaggtcctaagggtgaaatttggaaaattgaggaaagcgtatatccgcttgtgcagctttgtgcaaagctccttaccgacaagccgcttttcttccttattaattcctatacgacaggcttgcagcctgcagtgctcacctatatgataagcactgcgcttaaaaagtttgatggtaaagtaaccgcaagtgaaatcggtctcccggtttcttcaaacggactcgtgctgccctgtggtgcaagcggacgctttgaaagtttctgctaatcagttctaaaataaaatcagccgcagtatttcattattttctatgaaatactgcggtcttttaatgaatacgcaatatattacaatattctctttttcttcaataaaatcagtatcagcacacatatgacaaccataacacctattataatcataaatccatgtgctgtcgtcgcaagcggtacccactttgagctgacattcatgccatagattcctgagataactgtcggaatagccatgataagtgtgatgattgtgagcgacttcatgacattgttaagtctgttgtcaatgaccgtgctcataagctctctggtaccatttatgatgtccctgtaaattcccgtcatctcaatagcctgcttattttcgacaattacatctccgagaagctccttgtcctccggatactgctcaaggcgcttgtatctggtcagtctctctaacacaactccattggcacgaagcgatgtggcaaagtatacgagtgtggattccagctcgtgaagtgcgatcaaatcgtcctcctctgtatcctctccgactctctcctcaatctcagtacgcatcttgtctatgatgcgcagatcattctgatacagtacagatatcctgtaaagaatctggtatacaaagcgcatctttttcttggtggaaaattcctttacacggttatttaaaaatacctgaagcaccggtgtatcctctgtacagactgtcactatctcatcatctgtaagtatgatgccaagtgggattgtggtatatgactccttgtcatgcctagtctctatcgaaggtatatccacaagaatcaacgtatacccatcctgcagctctatacgggagctctcctcctcatcgagtgctgcaagtacgtcctcaatatcaacattcagatcatccgctaccatctgtccctctgctacagaagggttgaccatctgtatccaggtacctccctgcagcgtatccagctcatgtattaatttgtcatctgtcctgtaaaacttgaccatggtgcctccccgtggcttttatgacacacataatgccacaaaatattttgacatcactaacgtattgtctttgaaataaaagatattacttctcagcatatttctgactctggctctttataagctctgcatcctcaaagtaatttatcctcatggcgcgcttgacctctgccattgtctgtgctgcagcctctcttgctgtctcgctgcccttccttagtatctcatatacagccggaatatccttctcatactctgctcttcttgcgcggataggtgaaagctcctcctgcatgatgttgttgaggaatttcttaatcttcacatcaccaagaccgcctcttgtatagtggtccttaagctcctgaaggttagcatactccggcagatactcctcaaaatgtcccggcttagagaaagcatcaagatatgtgaatactgtattgccctccacatgtcccggatctgaaatctggatatgtgtcggatctgtatacatgctcatgattttcttctttacatctgcctctgtatctgccagatagatacagttgcctaatgatttgctcatcttctgtccaccgtctgtacccggaagtctgcaacatgcctcattctcaggtaaaagcacatccggctcaacgagcacctcatcatagatagaattaaactttctgacaatctccctggtctgctctatcattgggagctggtcctctccaaccggaacagttgtagccttgaaagcagtgatatctgctgcctggctgattggataattgaagaagccaaccggtatacttgcctcgaaatttctaagcttaatctcattctttactgtagggtttctctgaagtctcgatactgtaacgagatttgagtagaaaaatgtaagctcagtaagctccggtatctgtgactgcacaaacagtgtagacttggccgggtcgagtcctgctgagaggtaatcaagtgctacctctatgatattctgtctgattttctcagggttgtcaaaattgtctgtgagtgcctgtgcatcggcaatcatgataaatattttgtcatactctcctgaattctgaagctcaactcttctgcgaagtgagcccacgtaatggcctatatggagtcttcctgttggtctgtctcctgttaaaataattttttccatctctattattcctctgctttagttctattattacgattgcattgtaggtttattcgccaaaccgtctgtcttagcaatcgccagctttctttattataacacactgacgtgtaaaagcctaggaaaaagaactctcattttaattattttatgatatctgcatactctgcctttgccgccctgcacaaatcatccggtgacagcgtaatctgaagcccaagcctgcctccgctgaccgtgattttgtccagctccttagctgcctcatggataaatgtaggatactgctttttcattccaattgatgtacagccgccccttatatagcctgtaacctttgtcaaatccttgagatgcagcatctctatggacttctcacctgctgcctttgcggcttttttgaaatcaatttcgtcatctatcggtaccacaaacacatagtatccgccgcttttgccgactgtcgtgatagtcttgtacatgcctgcgtggtcaagccccagcttgtctgctatctgagctgcatccacaaagtcatcgcactcgtatgtgcgtgcctcatatggaatcttcattgtttccagtattcttattgcatttgtctttgcttctttttttcccattatactatctttcctccaataaacttaagatatattccatatccaagcttcttatatttttttcaatatttagtataaagatgtgttccttgttattataatacaacggaaatttgatatcgtaaataccttataaagtatctaaaaagccacgacacaatgaaatgtatgtcgcagcttttttattcaaccactatagctattcacaaacacctgcaattagagaaactaatatgtcatatctttatgcaattgcctcattttactgattgtccgcactcttatcggcatttttgtatgcttcctcaaagaactgctcctgcgaatctatcggtgtgctgtttatctttctgtccatatactcaccatcagcgcaaagctccttgcccttctcgtcatctgtcatgattgtgtcgaagatatggcggatcttgtccttagcatgtgcatcgtataccggtgttgcaacctccacacgtcttactgtatttctggtcataaaatctgctgacgcaatgtaaatcttctcatcatcgcccacaccaaatctgtatatacgtgaatgctcaagatatcttcctacaacacttattacagtgatgttttctgtggcgccctcaacctgtggcttcacacagcagattcctctgacaataagctctaccttcacgcctgcctgtgatgcatcgataagcttgtctataagcactttatcagtgagagagttaaccttaactccgatgtatgccggttttcctgcattcttattggcaatctgctcgtcaatcatgtcaacaatcttattctgcaggcattttggggcaacaagcagatgttttacatctccgtccgaaacagtctcacctctctgaagcgccataaacacccttgatgcatctgctccaatctcctgatttgcagtgataagggataaatctgtataaagacgcgaggtcttctcgttgtagtttcctgtaccaatctgagtgatgtactcaaagccatcgccctttttctttgtgatgagacagagctttgagtggaccttgtaatcaccgagtccgtaaagtatctgacagcctgcatcctcaaggcggtgtgacatctctatgttgttagcctcatcaaacctcgcacgcagctcgacaagcacgataacttccttgccgttttctgcggcctctataagtgcatcgataatctggctcttgtctgccactctgtaaagtgtcatcttgatagaaactacatcaggatcctctgctgcatcgttaagcatcttgataaacggcttcatgctctcaaacggatatgaaagaagcacatcctttttctcaacctgaccgagtatactctccttaagcgaaagctcaggtgtgtcacgcggtgtacgcttctcaaagaaaagctcctgcttgtctcgcagatagtgctgaagctggaatacgaatgacatatcaagcggtgtttttacactgataaaatgctttttgccaatctcaaggaagctcgagagttcgtcaatcgccttgcggttgatttttctcgaaagctcaactcttacagggtcaaggcgcactctcctcttgatgagctcctccatcatattacggtaatccatatcctcgtcatacatgctctgcgcatcgatatccgcattacgggtcacacgcatgattgatttctcacggattacatactttggatagagctttgatacaaagtgtaaaataagctcctctgacagcataaatgtgcccggtcttgtaggtatctcaatcagacgcttgaatacgctgtttgagcatggcacgatacctgtctttttctttcccttctgcgtggttaaaagcactaccgcatagagctgtttatttgcaaggaatgggaacggctgctgctttcctataatcattggtgagaggaaaggtgcaatgtgtgcatcaaaatatgcctccagtaaatcaccctcatcctttgacagcttgttgaaattgattatgcgcacgccctttggctcaagctcacccatgagctgctcgtaaatccttgcttttttcttctcaagctcgcatactctgtcaaggattgccgatacctgttcctcactcgacatctttgtcttgttctcgaaaatcttttcctttgaattcatctgcatcatgagtgatcctactcttaccatgaaaaactcatccagatttgtctggtagattgatgcaaaggtcagtctctctgcaagcggtactcttggattgcccgcctcatttaatactcgctcattgaactgtaaccatgacagctccctgtttgtgtaaacttcttccagttttttcatctgcatatatgctcctattctatatgatattgtttcattcgcgttcgcgtcttttgggtctgttttattttgtgcccgctgtatttcaagctgtcttgcacgctctatcagcttgtcctcccggcgccttcttctgtctaccagatgaagcttattttccaccgcaaccagcatccccgcaagttccttcaaaactctttccctatgcaatacgtacctctccgttgtcatcatcatctatgaaaaatgactgcatggtcacattatcattggcgacctccacgagattcacacagctgtttccgattcggtctatattgtgaagcatctcgttgtactgagctgtaagctttgaatcacatttgccctttccgacacgggtgatatggtttttacgcagcctctcatcaagcgccataacctcatccttctgtttctgaagggcctcaatatccatgcttccatcacctgaaatggctcttattgaagcaatatatatctcatgaatctgtgccatcgcctttctcagctcttttaatgcatcctttgaatatttgtgcttgctcttattttccacagatatggtattgactatttcgtttaataatattccaattctatctatatcgcacagtacataaagcactcccgcactctgtgatgcctgttcctctgtcagtacaccctctgagtacatggaagccagatagtcgtttattgacacataaagcttctgtaatgtctgtgcactctcttcaagttcattttcgatatttttgccgtttttgtcaatacattcatgcaaatttacaaacatttcttcaacaatatcagcacatctgagcgtttcctttgcaacaagctgcattgcggccaccggctggctgatgagcttggtatcgaggtacattggctgacccattgcaatctctgtaacgctgtttttttccggcacaagcttcataactatctttaccattacagggataagcggtatccagataagcgtcattgtcaggttaaagcctgtatgtgcatttgcaatctgtcttgagatgacatccacctcatttccctttggtgaaataaactgtatcagggcagcatatggtttcacaagaaaaaggaataaaattgctccggatatattgaatacacagtgtgcaaaggctgttcttctggcatcctttgactgtccgattgacgcaagcactgccgtaattgtggttccgatattgtcaccgaggagaatcgggatagctcctgccagtcctatgatgcttgtcactccgtcaggtcctgcctgagatgcaaagttctgcaatactgcgattgttgcacttgaactctgcaccacaagtgtcatgagtgctccaactgcaacacccagtacaggaatatgtgctacctttccaatcatatctacaaaaaatgggcttgaagcaagcggcttcataacacttcccatagtctcaattcccaggaataaaagaccgaatgcaaatattgtctgtccgatattttttactttttcctttttacatacaaagcttaatatgaagcctgcaaatattatcagataaatatagtcagatatcttaaatgcgataatctgtgctgtcatcgtcgtaccgatgttagcacctaaaataattgaaattgcctgcggtaagctcataagtcccgcgctgacaaagccgattaccatgactgttgtagcactgctgctttgaagcactgctgtagtaagcgctcctgcaagcactccaagcaccgggtttttggtgagcatcgcaagaattgccttcatcttctctcctgctgccttctgcaggcattcgctcatcatgttcatgccgtatataaatactgccaggcctcccaacaggccaaatataatttttaccgtttcattcatctacttatcctccgctttgccgtttagctgtgcccattcggttaactttcctgtgtaaatctctccaagctgctctatcgaaatcctctcaatcggattttccttatttacaatcacatgtacctcatccttcgcaatctcaaccttcgtgagaagctcattctcatatgatttaagctcacgcgatgacattccgatgtcatatgttccctccatcgctcctgtcagtccgttgcctgaatcagtctctgtaactgtaattttagcatttggatttatctccatatatttgtcggccagttcctttacaagtggtgtcgctgatgtagaaccgccaatcttaatctctccgccggccttgtctgacagaaatgagcccggcttcgcaactgcagtatacttctcactgaccacttcctgtccctgcgttgatatgtaacgcacaaagtcatcctcaacatcgtttagctctcccttgtaagccaaataaaatgaccttgtaagatcgttgccatatatggtgactgtctttaccttgttatcatcaagctccacacccgatgacacatatgcgatagcatttttgtcctctgcggtcttttcatatgctgtttcattgctatctgctacaatgctttggtctgtagccttatcctttccggttgtctcatccaaaatccctgtcttttctgcaaagacatttctcgttccggattcctcttctcgcgaaacaacctcaatttttcccaacgaattaaggccatccacatgggtagtttgtacctcttgtgaacagcctgttatcattgttgccatcattcctatgacggccgctttctttagtaatttctttttcaacatgatttctccattagcatgataaatgattaaaattaatcaataactattcaacaagttaataatatcaagctaatgtaaagtccaaaacgcagttatgtaaaatcatggtaaaaactttacatttctttactcagctttacataaattaattttgtgtgcattttatatatcttttaggcatttttaactatttcaacagcaatatccggataatttgtgataattgcatctgcttctgccttgacaagtgccttcatctcatgcttttcgtttacagtccatacatgagctctaagtcctcttccgtgcgccttgtcaatgtagttttcatcctgcatatgataggttgccggatgaagcgcatccacatgaagctcgcttgcatactctgccggatttactataatatcagaaaaaagcagaccgcacctcatatcagggcaaagctttttcatgcgcacaatcgactcgtgattgaatgatgagcaccagattcggtcaagcatatcatactcttccacgagcgccagtacctttttctccagatttttgtactgtacgataccgtttttgagctcgatatttatggtcatctctgtgtttttgagcaggtcaaacacctcatcgagtgttggaatgcgagtcttcttgtcataggacggcatgtgctttgacacattgaggcgctttaactccttgagtgtatagtcctttacaaagcctttctctccactcactctgtccacggtctcgtcatgtatgaccacaagctctccatcctttgtgagctgcacatcaagctccacgccgtcaaccttcatcttttctgccttcttgaatgcctcaagtgtgttctccggtgcatatccggatgctcctctgtgtgcccagacctttgttccctctgtgtttatcatgctttaagccttctttcgttactttttattttagttattttcatgcctcggtgcatcatatctgtctgcaagccttaaaaatacaaatcccactgcaaagaatattgccatagttgcaaccgccacatttatcgtgccgcccgcaagctttactgccgctatgacaagcgagcctaaaaacgaagctccttttgcaaaaatatcatagattccgaaatactctcccgagttctcaggaggaataatctttgaaaaatatgagcgtgacagcgcctgcaatgagccctggaagcatcccacaccaaacgccatgattccaaagccaatcagatcatgcagtgtaagtgcatatagacaaactgcaaaatatcccgcaatgcagacatacaaaagtgttgtagttttgtatgtctgtgacagtcttccaaaaacaagtgaaccgatgcatgccactatctgtgtaaaaagtaaaaacactacctgtcccactgaatcgagctttaaatcagttcctatgtttatacagttatctattatagtacctacaccatctatgtaaaggaaaaaagcaaccaaaaacagtcctacttttttatcttttgtagctatttttttgattgttccaaaaatctgtgcaaatgcgtcagctataagtcttaggactcccggatttttgtttgttttgtttttctctttgatattgtctcttataaatgcatcattttcaaaattcttatgaatatctttgtctgccgcatccgatacataattcacctgtttatagctcttaaacaatggaattgtaacaacaaaccaccaaattcctgtaacagcaaagcctattatcatcgacaggcggtttgatatgtatccaagcatatccggtccacagatgtacgctgcaagtgaaacaagaaacggcacacatgagcccagatatccccaggcatagccgtaggaggacacctcgtccattctatcctttgtcgtcacatcgacaagcatcgagtcataaaacaccagcgatgcattgtaaaatatctttgtaagcacatatataacaagaaacagtacccacgtaggtgtaaaaccgttaagtatacatgccgacactcctacaactactgtcgttgaaaaaatggcctttttgatacgcatatggtcagctatcgcgccacatacaggtccgataagtgctgatacaaccgtcatcacagctatcgccaccgcataatacgcagtcgccctgtcagatgaaatctgccctacaccatctcccacggcaaggcttttgtaccatatcggtatgagtgcacacgcaagcagtgtgtatgcggaatttcccacgtcatataatacccatgagagctcctttgacgagagctttttgcttttcttttgtgtattgtcttcttttgatttcataaattataccttccctgtttatatgtcccagactatgattttattttaaatacgtaaaaaccgctaccgtccatttgtaaagtttatgtaaacaatccgaacaatattaagtcagcgactctttcgcaatatccacataatgcatggcgtttcgatgattctcctctatctcctcagcactcagtgacctgactacctttgccggagagccaaatgcaaggcttccatcaggaatctcggtgccctgagtgacaagggctcccgcacctattatacagtttttaccaatccttgcgccatttagcacgatggctcccatgccgatgagtgtattatcacctatagtacacccgtgaacaatcgcgctatgtcctattgtcacattatcaccgattctgacactgtggcttaagtccacatgtaccaccgcattgtcctgtatatttgagtttctgccgatttctatcggctctgaatcgcctcttactgttgcattataccatacgcttgctccgtcagccattgtcacctgccccttaacaacagcgccttccgctatataatatgccatatctatccctccatcaatttcagataatcgcccttgtctatatgcatcatcgaaatctgattattgtgccgcctgaagccatagacacagtccacatttcggataagcgactgcagacgctcatccggcacacagacaatcagctgcaaatccatctttcttgcatacttaaggcacaccgcacttcgctcctgatccatcttggaaaaagcctcatccaaaagcaccagcttaatctttgaatcacgattgctctgctgcatgtaaagcatcgcaaaacccgcaagaagcgcaacatacttagggttctgtccctcaccgcccgaatcacggcctgccatgtcatctacaaagttttcccttatgacctgaccattttcgtccgtaacctgctcatacatgctgaatgacagataattacggtaatccgcatactgctccatttccttacgcttctgcatgcgcagatgctcatcttcatcctttggcggcatgaacttgtctgtcaaaagcttaattttctgctcatatttcttataaaagtcatcctcgccaaagcttatctgtccgtctattccgccattatccaggtttttgctgtccagctcctccgccataagcatatcatagaactgaccgttttcgttttttgccggctctatcttaatctgatacgtgctgtctgagaaattagtctccctgagaagcctgtttatctcgtaggcatggcgctttgcagccttgatatcaccgtggattgtaccgatgacattctctctgagacttttgtagatcaccttgcactgctcctcaaattcactctcatattccggctcataatccttctcgtacttctccaacagctcctcgtatgccttattggacttctcagctccgctgaactgacctgacgggaactcctttatatacctgtaacgggcagtctgcaacgtctccacacacgactgctgcctgccaccatttccgtctgcgccctgcagctcaataagcttctcacgctgtttgctcttgacggatgctcctgagctatgctgcagcatatcctgcacctgcttctcaagctcctcccttgcaacatagccctctagcatatcatccagctgtgctcttcgctgttcgtttgcacctatgattttctcatgctggcttatcttttcatttatctgctgttgattcagtgaaaaagcactcttaagtgcatcgatgtttttctcaagaagcctctttttctcctttagctccttgtactgcccattctccattgtcctaataatctcttcgagctcatttttctgcgaattaactgctttaagctcatctgacgcctcagaaaggcccacaaaatactccggctccccctttaagcactcaaaatctctctgtgccttgagacttgaaataatacccataagctgtatctggtccttctcaagcctctccacatctgcctcatactcggcaagtcttgccttggataccctgcctcctatgcaggcatttgtagtataatcgcgcttcttcagatgtctgaaaataaagttgctgtatgagtagcagtccggtgtaactccatctcgtacctgctcaagctcgtcaacactccggcactttataatatgtcccagatatcttttcaggcagacatctacatacttttcctttgtatccactgcttcataaagcgaaccatccatggcctttggttcactgtccatgatagccttggaatttatgaggtcgacatcctcaaactgcttcatgtccctgaaaataacagcagcagtatgcgcataacgcggctctgtgataagggagaacttgagccttcccatacgtccttctatggcattcttccattcctcgtcctgtacgtcaaacatatctgcaaatacctgtaccttcacaggctcgcaaaatctatcacttaagtctctctgcagcgcagctcttgccaagcgtagactctcactgtacgacttacggttgttcttcatatcatcgaccagacgttttttctctttaagctcttttgttatctcatttttctgcgaagtattgtcctcgagctcatcctcgatatccttctttatagactcaagctttagatgaagctcctgacattttgcctctgtgacatcgccatccacaatctcttcaatgaggtttaaaactgcattgctcacataatctgtgatgacctcatcctcatcccaggcctttagtccgtttgtgattttaatccactgacggctgttgtcggtaagcatgagacttctcttctcaagctccctaagctgatcctttttgcttcctaagtcgctcgatttcaaatctgcacatacctggatatactcctgctgcacagctgcctgctgcccggctatatcatctgccttttctgaaagcctgtcctgttcttcttcaatacgctttttatcatcctcagctgcctgaatctttgcacgcatatcctcgatatctatgcacctgatcattgtctctgccatgacaatatcgctttggatatttaccagttcctgccctgactcctttatttccttaagaagctcaatacgcttgcgcatatcctctattttttccctgatttgtctgtatgcatcgagctgctcactgatagtctctatcgtgcccgagtcactctttggaaacatataatcacgtataaactggcctgttccatttgtcattctgagtgcaatagcacttttttccattgtgataaaacgattcggatcaatatatcctaaaatcacatcatataatgtgccaaggtatgcctccttcgatgcgtaaatacggtttacatcccctctggcgcgtctatcagctgactgtgagcgagtatttacaagctttttaatatcattatttgaatagcaaaagccgtccgatgtcacatatgaaggctccggcattctgccagaatgactgaagtacacaaatctcttaatctcagaatcgttttttcgtacctcaaatgctattcctatacatgtaaacgtatgactgcctgtatcctctatctcaagcgctatgaccgaacaaaaatcacagtcgccacgatttgcggagccatccttctgctcacccctcaaatagctcagaacacttctcctgttttttgcatcatctgcagccttgttcaaaaacgtggggctgaagctgccgtagaggattacctgaatcgcatccatgacggttgattttcccgagccactcttaccactgaacaaattgacatactcattaaattgcaaaaccttgtgatttattccgccccagttgtttagacacattctggtaaatatcttcttagactgactcaattggtaactcctccatttcactgttcttggcaaattcatgggtatgctttacagaactgccttctgtattcaatccggcagcttcaagtgttgcagccgactcgttatcatacttaatcagctccacctcatcactgtacatgcgcacaagctcatttatatccatggctgagcagaatatatttactgtgccataaatatagattggtgtgttgtcctccaggtttgcaatagcccccggcagttcaatcatctgatgtgttttcataagcaaaagagcgtctgaccattcctgattattgagctttctggtaatcagattggtatttctgccatactcacgaatctctgccagattcgttgttgtcgcattaagtccctcgcccatgattttatccctgtatatcatcttcattataatgacaatccttgcagtaagaagagtcatcttctcaagcatgacaccttcaccctttatcctgaaaagatgctcctgctggtcatgaaccagctcacagtctagcacagccagataatcagagataaactctctgtttctaagacacacctgataccttggattgtctctttgaatcaatgtaacggggtcacacttcatttgtaaaatacaggtctgcctcaacagatcctgaatagtttttctaatattttctgcctcatttggcgaaacattctccatatattcaaacatacattgctctcttttctatgcttctcgtttagagtccgatttggatattacaagccttgagtagcttacaccatcattctttgttatctctccatccagactcaccgtatcctcacccatgcgctcattggtctcctcctgccataaaaacagaagcttttccagatcctccatggattctacagtctgttcatctgtcacaaacatgccatcacgcatatttttatctctgaagctttgaagctcctttttggtatacaatggctttggcacaaaatctgccatatcatcttcgcctgccgaagcatcgtcaataacaaacggaacaaactcacttcttcctctctctcttcttcccggaaagctgtcgtccgttacattgtaaaactgtctggtgaacttcattctgtttcgaagagccccaagtatctcatctgttttatcactcttatctatcaggttaatgagctttactatattatcctcgtcatctgcgccttcctgcaggatatagtgtatccttgcaagcgccctctttgcaaaaatcgtcttctgctcaataagcttgttgtactttctctcaatcaggtcaaactcatgctccaccttataaacaagctcacttgccttatcacagtactccacgctgtactcatagcgttttctctcaaacgtaccgggtgtagtctgcgaaagaattccctcaagctcagcccttctgtcatcgttctgattaaggattttgcttataagctcctttacagcctccttgtaacgataaaagctatccgtggttgtaaggatggcataacgtctgctatcactgttattaatttccttaatcagtaccttctgtatacctataaaatccttcatacgtgacagctcatcaaaatatgccctcataccatcctgcatatttgataaaagctgaccaagattttttgacgtatacaacgcatttttcagaatatcattatttttttccggatctgaaaaatatgtaaaaagcgcactgtaaacagccaaaatgctctcgcgctccctgctgtcatcatccacaagcagctttttaaatagctcagcatacatctggctgtactgaggaaatgcaatcacatatgtgttgagcttttcatcaaaatcactcctgatccagccccagtttataagcctgcccaatatagctgatggtgtcagggtgtatgcgaaactggcctggtcatatataacatcaatttcggaatcaggattataataatcatgattatccatgctgccactatctttatcactctcatcttcattataatcagtctgccatacaatgcctgcttttgatatggtatccgctatgattatctgacactcctcacgtgtcagtcccagtgatgcatagacctcgttattctcctcatataacgcaacaactatctgcatgtatgcatccatatttttcgtgcggaataagctataaaattcttttggtattctatctttcaatgtcatactcatataataacatatccccacgtttttcgccatatacatggaaataaacgtggggatattaatattgctgcttcacatctcagtcttaacagtaacatccggttaccgtcaaatcactcctgattgtgaccatcaataattctattcaatataatatgcttactgctcagcaactctcagatgacgtataagctcatttaagctctctgcctcactgctcatctcctgacttgcagctgcacactcctgtgaagaagctgagttagtctgaactacatcgttaatctgctctacgccattattaatctgcttgatagcatctgtctgtgtctcaagtgtctctgcgattccattaacctcatctgtgatagtcttggaattgcctgcaacctcctcaagctgtgatgctgtcttgcctgcaataaccattcctttttcaacagccttgactgaagactcaataagagctgctgactccttagcagcatttgcactctgctcagcaagtacagtaacctgatctgctacaactgcaaagccttttcctgcctctcctgctctggctgcctcgatagaagcattgagtgcaagaaggtttgtctgtgatgcaatctcattgattgttgcgatgattttaccaatctcctgagatgcctcattgatttcattcatagatgtaaccatctcatgcatctgtccgttgctatccataatctcagttccgagtccatcaaccttctggctgatttcctttgcatgctcggcattctcagctacctgatccgctacagaagcaagtgtggctgtaagctcctcaacaacagcggcctggtctgttgcgccctgcgccagatcacttgagctggcagctacctgctcagcaccatttgaaacctcatttgccgctctctggataccgctgactgtatctgacatgctctcctcgaaagcaacgattgattctttaattcctacaaaatcgcctttccactccacctgtggcttaaagttgaaattgccatctgcaaactgtctcatagtctggtcgatatcatcaatatatgtgccaagtgtcctgatagactttctaaggtcatgtgcaagtttgccaacctcatcatctgaatgatactccagattgctgtgaagatttccattaacaagctctcccgccactacttcaatctgctgtaatggctcaagcacagaatcaataacctgatcactgattttttttgcaatcattgtggctacaattccaactattattacattagccagtcctataatcaggaaaaacgtagcaactgttcccgactcggcaccaaagatattagcctttgcaccaaaataaaccagtaaaattgctacaattgatatacctcctgatacaagcagcatatccaatactttcttatagccatatttcagtctctgctgaagtggcatttccattattttgcttttagcttcctcacccatatgtaattctccctttcttatttaggtttcgttctatacagtaagattattatatcattaccatagtactatttcaatgataatttgacaatattcgtcatttttgacatatcgcctaattttagaaatgatttatagtcaaatacaccaaccacccgcttattacacctcgaaatccatacatgccctatttgcagtaaatggtctcaccttggtatcagccacagcaacatgcttagggttctttgcgtatgccgcaagtgcttcagcatcttcaaatgtagtatcaagcatcacatctacggtagatgtcggaagataatctgtgcgtactgaaatatcaagcatgcccggaatctgtcccttaagtccttctaggccttcctttatgccggcgcgtatttcttccttctgtgcctgagtgtactcgtccttgagtgtccataaaataatgtgtttaaccattgtgtgcctcctgagttttatccaagtttaaattaaatattagattatattgtaattcacatatttaggttaagtatagcatttatataaagaaatgtcactttatatttgactgtcatatctgattcttttaggctataaagctcaaaaaatagagccattttagagtcatgagttcttataccttagtttagtaaggtataattcgtcaaaaaaggctcccgagaaaactctcggaagccttgattttattgcatatttaaataatcagttaagattactcgataactgtagcaacacgtccagaacctactatacgtccacccttacgatatcagactggtgtattacggtgtgcaaatggtggtttttcgtatgattcatggggaataatctagattttccgctatgtccgtgtggtttttagggattttgttatcatggtgttatcattattcactaattgaatatgcatctacaaaggtttttatttcatctaaacggttctttaaataatccgttgtttccttcctttcaaagcactttcgatccataatatccaactcaccatctttggatgcgatatacgccactattccgcagaaaattctttcacactcagtattattctcaaggacctccaaaatacttttgcaataattttccattttacgagcattaaatcttggcatttcctctatagatactaacattctgaataacatcattgcatgatatctagctcttctatattttttatcaatcttgtgcgtcttaaatagattttcaattttgtacaatgctaaagaacttacataatatataatttctttatctgctgttttgaatattttatttccaacacgcttagcaaccgttccatattgtcctgacacaccgcttggttcatccaaaaacattgctgcaacagtttttatctgcatcgcaattgtaacaattctatttttaggaatattactatctctatattggcccgttcgtctctcatatacgagtgcatcttcatctctatatgtcttataatactcttccaattttttctggaatgttgacaatgcttccaattgatctttttttatagcagtttggctattggtcgctctcgtgatatcatttttcaaattttcatctttagttgcaataatccttataggaataatcaactcatcaattccttcaacactatccatattttcaatcaacacattgcttgtttgacagccgtttacaatttgataatcttcaatcgtagctatatctcctgaaataattattgaagaagtaacaactgtaattccattatttaacatactaaatgcattgacatttcccgttttaatagtctctgttatatttttattcacatctggatttggtcctagataatctcgtatgttatcttcaaatacagctttagtagcgccgttttcgtctataattaactttttaaattctttaaaaggcaaaaccccactgtatcccacttcatcatcattgattgaatacattgtgattctcttttcaaatttgaatatagactttaatttttcctttgtctttcgatataaatcttgtattttttcagacccacaaggttcaaaactgatattagaaaacaggtttgtcccccgcaagctttcctttcctacactaattgttgcttgtaaattttcgtcctctgtccacgttcccaacgtaacataaaataaaaataattctggattcttcttcaatttatcccctttagaaaatatgtattccttcagttcaataaaatgttgcatttccggtgtatgaaatatgctcgtatcatcactaaaaaacagctttgaatatgtcagcaaatttccaatttcagtattatcaaaagaactagatgttttcgcttgaatcaacacaaacttgacagatattgatttattatactctatcaatgtatcaatatcttcaatagtatttacaaatttttgatttacaataatcgcaattccatctattccttgtgttgcttttcctgtagttatttcctctaggtcaaaatcatttgaaccatatatattattcacaacacaataattcacaaaatattcaaatagttctgaagcatcatcaatattcaaactttgattattcttgaatgaatcaatcatgctttgtgtaattctatccatattttttcctccaatactgtattttttatgtgacctcgtataaaccacactctctccccctgtctttgtataatttatactatatgccacatatatttatattatgcctacttatccatgctaaataaaaaatgtatagcttttattctttctcaaataaccggtttaatgttttctccatatctgccaccagattaaccaccagtgcatttcccatcataaatctacgttttctcaatggcatctccactgtttctcccttaaccagacagtactttgtatggtctgtaggaaatccttggattcgttctgcttctgttgcggtaagcagtctcactcttccagtcatcttatctttcacaatatgagttgtcctactgaatccaccttctgatgtcagcattgtacgtgccggtttatcttcctgatcgatcatagagatagcaccctctgagaatacatattcatgacctgtcgaacttgtacgtaacaatttttttgcccctttcaggtactgccatgtctgtctatcctcctttggaagacgctgttcagtttcatcactatgtgtaaccgcaggatccgtataatataatttttcttctgggataaaatactgttcttccacttgtccggtttccataacatcaccaagagttatctgttttccatgataatccggaacagtcttcattgtatatattgttccatctttcattattccggaattttcaaatgcacattgaaatgtttcggacacttcacctacttctaccggcagttccttaattttcatcttagcagattctgctttatttacaggaaatgtttctgcaaaaaaaccttctttcaagactgcattttccatgcattcttgtttgcattcttctttcaacacatctgtgtatccgattgtatttaaaattctttttgcatactttgtgttatttttataagcaaaaataaatgttctacgacgtctttgctgatatccatattccgcagcatttatcacccgccattccactgtatatccttcatctcgaaagcatgcaagaatcacaccaaaatccctacctctttgttttgcaggagattttaataatctatcaacattttctaataatacgaacggtggcctctttgcttctaaagtctcacgtattgaccaccataaaattcctttttttccctcaattcctttggaagtagccaatgaagatgctacagaatagtcctggcacggaaatccgccgactaacaggttaaaatcaggaagtgttgttttatctacatcttcaatattataatttgttgtatcttcaccattattatctaatcgtgttccgaatcggtatacataacagtcatgtgcatactgtgtatttttctctgccggctcccactggctaaaccaaactgtatcccatttttcttctttaccataatcctctgttgtttttatattattaagtccacatctaaaaccaccaactccggcaaacaattcgcaaactgttttcttcactttatattacctcttcattttttgtccgaacgatcgttcttaaatataataacctatttttatattcttgtaaagatccttttctattttttagtatgattttataaaatctttaatctgctgtttcatatatttcttattataccaaaagcactgtttggtcatgtattctccagtaggtatcggagtatctttcaattcctctggaatttcttttaaagtaataacctctgctggcttttttaattttactgaatttgcattttcacaaaaatattcgctctctccagccttatttcttacatgagccactttattaaagctactcttcgggaagttattttcatatataaatattaaccttcccgctctgtcgtgggataatttctgttgtaactttattccatttttaataactcttcttgcttcttcccaaacatcttttactttatttacatcctttttcggaatataccatatgagagcattattcaatatttcttgcccttctgcattcgttgaaaatatcacaagtaaaaacttcgaatctaccatctcatcataagcaatagattctgtccaattcttttctttcagcaatccctcaaaatcaaacgccgagaatggcatatcctgcgttggtgttcctttttcatcaactgtaagcgttcttaatttatagttagctttttgaaattcatcagtttcttctaagtcattctcgctcttgtatatctgtttgacaatatcgttcttttcactatatccgctacgataattaggaaattcttttttcaatgactcaactgttcttcccaaatatggtttcaaagtttcaatcaaaatatcatcaaactctttttcctttggcaataccgtatctggcaaaatgtaagatatttcctctgtggtaagcattctctcattgaacagctttgtcatatatgactttttaaatgaatatgctcttggttttgctttcggatatttatcattatattttactttctcatctccaccactgccttttctagccggactgagatacataaagtcacgttctgataattcatgtgcttttccctcttttacataacgtgcgattttttcccaatcatgctgaataatcatctgatctctttctggtaattcttccagcagaatctcgtccactttctctacactgaacttttcacgttttacccctttaatatactggtaatacataaccagcagatgatgattttttgtccaaaatctgctttcctcatactcgttccaattttcatctctatagttaatttttccaagtgataatctctcttttgctctatatcccctactattgattaaaaatggagttactttcaattcaatgtccgcatctttaaaatctggttcagcttcttcattgcacgcataattaaaccagccttcttcataggcttgcccaatatccccctttccgtgcttctcttttaatccattttcttgttgaaatttccgagctaattcaaaaatttctttaaatgaatgtcctattgcttcttccgctctctgttttacttcttctgaagttttatattctttattacccattatcaatcctcaataaaattcttatccaactgcgacaaaatataactattattcaaccaaaaacattgctttggatactgtcttccgtcgggaagttcataagtatcttttgcattttgtgcatgtggtcttacatggcacactagattttctgatgattttggaaaattattataattctttccatttttcttttctatatgaagtccttcgcgaagcactctctgcgtcttttcccaaaccaccttcacattgctttccaaatcatcatatggaatattccagaactggcaaccctttaaccttaactcatcttgttgatcaaacttataaaccacaaataaaaatcgagtttcacgtaaataatttccaaatgtagaatcttcccagtcttcctctactaactctttaaatttgaaagttggaaatgacatattttcctttatcttattatttttctcaatgcgtatcgtcttaactaccacatttgctttttcaaattcttccgcatggttcccttttatgcctaacatccgatatgctaatattgcctccaggcttttcggtttcttttgatattctatatggaatgtattacataaatcagtaaccgaccaatcgcaatacgcatctattttactcacaacataagtctcaaaagattcctctaccgtacctttgataatcggttcgtatgtatttttccctggaataatatagttgttcagaacatatgtcatgtatgaatttttaaatgcaaatgcccgtggttttgctaattcatcactaaacggctgctttctccggtcctttgacgttgctgcttttggtgctgctcctagatacagagtatccccttcagataattcatgtgcttttccgtttctgattttctcaacaataacctcaaaatcatgtgctatgatttttatatcttgctccggcggtgcaaacagcttcacatatccaatacgataatccaaccgattctttatctcttgttgatacaaataatacaccaataaaatcaaccgggccttttgccacatatgactatcttcaaatgtctcatcgacaactgaaaaataatcaatcattgtcaatatcagtctttccttagccaccaatgtcccattcttattttgtttatacggtgttacttttagttctacaccagctttatcaaagtccggacgtgcatcattattcgtctgatagtgaaagaatctctcctctattagttctcctaaaccgccttttcgcttcttattctcatgttttacttcgtaatttgcagtctccctgacaaccattgctttagttatatcatctttcctacacacatcagcaaatgtttttccaattaacctttttgcatatgtttcaattgaaataggatccgtttcatcgtattcttccaaataattcatcattatatttcctcttcatcgtctgcttcttccaatttctggtcaaatattgtctcttctatcactctaacgcactgttctgtatctttcagaatatcttttccccagaaatgtatcacagtccaccccataaaattcaattgctggtccttttcttcatctctctggatattccgctctattttcttaacccaataatctggattttttcctttttctaatcgtggcttcattatttcccaatcttttccatgaaaaaattcactgtcacaaaaaattgcaatacgatattttgtcagggcaatatccggtcctcctggtaattccctgtaatttttgcgataccgaaatcccctatgccatagtgcctttctcagcacaatctctatacttgtatcttttccatgtatcttgctcatattcttatggcttttttctgtaacttcgccatgaaaacgaggttctttcgtcggcataattttctccccctcaataccgtataatctattttattgtatcaaactaacagtcactattcaattccctgcaaacagaaaaaagacacgttttttaatcaacgtgcctttcccatatcatatttgattttctcttacatgtattatttatacataaaccatttccaataacaccatttcttccgcaacattcttaatactattcatcctccgcccctattccatctgaccctacatcttcagttcttctgtcactccctattgtccagccatctgctccaccagcatctcaactttttctctgacccctttatcaatctgattcagatgctccgtcagtttctcggccagtgctagatactgatacctggcactcctgtgccccttcaaaaactattttcgcattattccatatttcccatatgtaggttcttcctcattgatttttaggtctagtagatactaatctccatgcaatgtgtagctcagtccgttcttttcattataaatttgtttcttcatattcttacaactccattataagtagatcaatttaacaagctcatttcatacaaaatttgaccttataattgtattttaaggtcattttaaggtcaaatttattgcaatttacttttcttttatgcatacacgcaaaaaaaggctcccgagaaaactctcggaagccttgattttagggtattcaaagttttttagggtctttactttttagggtctttcgttcgggttcttcagtagggtctttcagtagggtctggttttagggtttatcgtgagggtttgaacctatatttataataaaaacagggtatgttagctcgtattacacaagctaatctaccctgtttcttttttgtcctgcctcatttatgattattttgcggaaataaaatttcaaaggaggacaaatgaataatatcacagatttactagaccttgaagactctgatataaagatttcagacattattattgaaggtcaaaccaaaactcttattatcgaaactccacctgttgccagctattgtccaatctgtgggtttcgcatgcactctcgtggtgtaaagaaaaggactattaaccatcccattcttcaggatggttattccttgattctgctactcaaacagcgccgctggcgttgttccaatccagactgtctgtatgaagttaatgaatccttccgctttgtcaacaagggacgtagaactacaaatgcaactgacatgctcattgtagaggcatatcgaaatcttttagaaacatccgcatctatcgctaaaagattccatatgtctgacacatatgtgcacgagatctttgaccgttatgtcaagctggacaggcttcctcttacagatgccatttccattgatgaagttcacctagatatggatgatgactgtaaatacgcattggtcatccaggatttccataccggtgcccccattgacttgcttcgcagccgaagaacttccgtaacggaaccgtactttgtctcaatccctgcaacagaacggaatcaggtaaaataccttatttccgacatgtacaatccttacattgcctatgtagaaaagtacttccccaacgcagtccctgttgttgattcctttcatgtaattcaatggattacacgttctattgacaactacatacggctgcttctaaaaaaatacaggcaacgcgaccgtgaatatcaggacaagctttcctatgagcagcaacgacctgtttcacttccgccatcagacgaagtataccttctgcaaaaatacagatggttaattctgtccaatcagtccaacatccggtaccacagtgaccctcgcatggattctcactttcatgtattaatgaacacctatgattacgaagatgctctctttcgaattgatccaaacttgaaagattttcgagacttaaaagagatgtacgtacaatttaattcacgaaacggcggaaatccactccttgcacggaatgaattaaaagaattgattcagacatacaaaagctcccggtttgaaatatttcgtgactttgcatctttattgaaaaaatttgaagaccctattgttaattcatttattatggtcgaaaaaatcgggaacggcaaaatttatgatgcacgtttatctaatggtcccatcgaatccattaaccgcaaagtaaaagatttaaagcgactgggcagaggcttccgcaactttgagcactttcgcaacagatttctttttgcaactagacaaacaccggtgcttaatggaatcactgattataaccctgtaacttattatgaagaaaatgatttttaggaggaaaccacatggaaaactactgtgcatttagtaaaaaccacacttgccttaaatggcttgactacataataacacgtcaagaactagaggaagcagactctctctgtcacggaaactggatagagattcaacacaagaaccaatacattcagaccctacaggagattctggacagcaatcacatctcataccccgatgaaatatagtttaatttaataaaaggtctggctacccagccagaccctcataaaagaccctcacgaaagaccctaaaaccagaccctatcgaagaaccctaaaaaactatgctttttttaaggccagaccctatcgacaaaccctaaaatagattggcaaaccctaaagaactttgattatcctgattttattgcatatttaaataatcagttaagattactcgataactgtagcaacacgtccagatcctactgtacgtccaccctcacgatactttaatatcattttacctcatattttttatggttttctctccaaaatacagtgaaaaacgactgatttgtactatttatttttatttgcctgatttcttggcaccgttttggcaccggaagcctcagtcaaaaagcttctcttctgttgtttatactcttctctatcagctttaatttatagccaaaaagcagccagtttttcatataaataatttctaataacttttatcgcctttcttcaaaggagaaaacgtaatcttatttgccaaaagaaaaagaattattattacaataccaaatcccacaaaaagtgaacttgtatcaacaacagtaactttgtatataatactaatcacaaaagataccactggcgcgcatgcgtatgtaagtgaaaatcgaattgcagaaacacgtcctatatattctttagtaacttcttttacaaatttcacttgtacataagtaatcattaatcccaatgctgcaccaattattatcgaaccgattagcaacagtaatttttgagttataggatttgcaatatattttgaaacaaatgcaataaaaacatagtatacacctaaaacaattccacaaaatgtaacaagtgtattattttttttctcctctttcatttttgcaaaagtcaatgatcccaaaatagtaccaatagttacgcttacacttagtaatgaaacaattttggcatctccactaaacatttctcttgcaatcggggcgagcagtgcatcaaatggaaccactgctgaattaattagaatacataaaaaacatagttttaatagcttcttatggtcaaatacataactaaatccatctctaagcgaaattaaatattctctgccaattattcggtttgtcttcttttcttcttgaacagaaaattctatttttactataagcaacgctgatattaaaaatatcaaagcatctatcgctaaagaaatacctattccaaatgaactaatcactatgcctgacaagccagttccaactaatactgctattttggtacaagacacattgacacttacacctttatcataatgttcattaggaagtacatgctgaataactgctacccctgctggcatatgaaatgcttctattaatgaaatggatattgtcataaaaaccaatattaatggtgaaagcatgttttgtgtatatacatataatatatacaaaactaacagaactcgagctatatctgaaagtactaacactttctttttattcatattctcgactaatggacctataaatggttgaataattacagaagtagcttgattaataccaaaaataatcgcagaccaccctgcactatttgtaagtaaatataccaaccatgtaaaaagtattgtatctaatgaatcaccacagcggttaataatattagaagtcagcagataaacataattgtggttatgatataactcatgtttattcatatttgttacctctctaatcataatttagattgtttaatttcgcaagctatcttataaagatcctgatgttttaaagccgctgctttttctataacattatcaatttctgatatatcattaagtgattccaaatattttttccattttttcatttcaacattatatgcacagtatctattttcactttcaaatgagccgttaatgcaataacgactattactacatcctcctaagcatcgttctgtataacgacattctctgcaaaatccttttaacttactactatcaaaatttctattccacttaaaagagtccggactttcccaaatcgactttaaagatttttcacgaatatttcccgctactaatgttttatctctaatagaagtacaagcaacaatatctccattatgcagaataccaattacatgctttcctgctccacaacctgtccaagaccaattatcattaagaaaattctcatttacttttatatctttattgctataataacctatgcaatctgccaaaacaattaataattgatatagttcttccaattcacatatattttctttatttattgaagttattactgatgtcgaaatattattttttcttaattctttcaatgctttaatacttttattgaatgatcccgatctccgtataaaatcgtgagttttttcaagaccatcaatacttaaacagacccttctaattcctgatgatatcgcattatgaataaagttttcatcaatcaaccaaccatttgtaataatacttgttattatgccattatctactaatcttttcgcaataatatgccagtcactacgtgtcgtaggttcccctccagataatgtaataacttttaatcccaaatcttttaattggtcacacacctcaagagcttctgatgtattcaactcatcgggtagcgcttctgcacaacttgaaccgcaatgtttacaacgcatattacaacccattgttatttcccatacagctgtagttaatttattcatatattctctcctataatcctttttaaataaaaaagacctactctatatttctttttacatagagcaagtcttttctacaaactacattctcacacctgttccgtacataactggtccaaataagttcttagaggtttttaattcagaaatctctacaaactccaagctcaattcttcaagattaaacatttttatccacctcccatttattgaatttatcttaagaatatatctcttattttcaaatgtcaagttattttcattattttttccaaatttcgagttcaaattctcgttttatttgtaacatattttccattttctacgcatacatcagatctcttaaccacttataaatgtccgtaaaattgcaaaagcaactggaatcagtgctacaaccttatattcaatcattcaaaaagattccaatattcgatttgattttgctttaagacttgcaaactaattgcaaattgatgtgaatgagatatgttctgccagtccattttctgacacaattaaggaagaagagatttatcctacacttccagacggtttgaacggagccttagacgcaagtcgtgtaaagacttacttaaaaaattctatgtatccgttgatgtatctttttggcaaaaatagtatgcctgatgtagataatctacttacatcattctatcagcttgatgatgaagccagacaggaagttgtagaaacaatccgtctgaaactgcaatatcatcgagatccgaaacgtgctgaacagatcaagcagattaaaggttggtaaaaaatcactcctgtgaatggcaaacattcgcaggagtttctttttgggcaccgttttggcaccactggtcttatttttcaattttaaatttatctgtattttatcttgctgataaatatttcgctatttctctacttataatttttcaaatcattccctctttaagatacagaaaaacccgtagaaccgaagttctacgggtatcttacgtttagacacaacgttatcttacgataacaaatccatattaagattgtattactcaataactgtagcaacacgtccagatcctactgtacgtccaccctcacggatagcgaatgtaagaccctgctccatagctactggatggatgagctcgattgtcatctctacgttatcaccaggcatgcacatctctgttcctgctggaagctcgcaaacacctgttacgtctgttgttctgaagtagaactgtggacgatagttgttgaagaatggagtatgacgtccaccctcgtcctttgtaagaacgtaaacctgagctgtgaacttacggtgacatgttactgtaccaggcttagcaagaacctgtccacgaacgatctggtcacggttaataccacggagaagtgctccgatgttatcaccagcctgagcctcgtctaactgcttacggaacatctcgattccagtaacaacagtcttctgaacgtcctctttaacaccaaggatctctaactcgtcgttgaggtgaagtgtaccacgctctactctaccagttgcaacagtaccacgacctgtgattgtgaatacgtcctctactggcataaggaatggcttatctgtatcacgctgtggatctgggatataagaatcaacagtatccataagctccatgatcttgtctccccaaggtcccattggatcctcaagagccttaagagctgatccctggatgattgggcaatcattgaatccatactcctcaagctgctctgtaacttccatctctacgagctcgataagctctgggtcgtcaaccatatcacacttgttaaggaatacgatgatgtaaggaacacctacctgacgagaaaggaggatgtgctcctttgtctgagccataacaccatcagtagcagcaacaacgaggatagcaccatccatctgagctgcaccagtgatcatgttctttacgtagtcagcatgtccaggacagtcaacgtgtgcgtaatgtctcttttctgtctcatactcaacgtgagctgtagaaattgtgattccacgctctctctcctctggagccttatcaatgttagcgaaatctgtagctgtgttaccagcgacacgagctgctaatactgctgtaatagctgctgttaaagttgttttaccatgatctacgtgaccgatggtaccaatattacaatgtggttttgttctttcaaatttagcctttgccattttgaaacgtcctccttaaacttttatgccccatgggctatttttataatctaccgactgctttgattatacgaaataatcaaagttttttcaagtaaattttatggcaaatccccctttttcaaggggaaatgcctttatttttgatttttataccatatatagtatatatttcatcatttgtactataaattgtttgctaatttgcaattattttgcgtggttagcaagaaccttgtcctgtacattctttggaaccggctcatatctgtcgaagaacattgagtagtttccacgtccctgtgtcttagaacgaaggtctgtagagtaaccgaacatctctgcaagtggtacatatgcatgtacaatctttccaccgccgagatcgtccataccctcgatacgtccacgacgagagttaacatcaccgataacgtctcccatgtactcctcaggcattgtaacctctaccttcatgataggctcaagtaatacaggtgcggcctttgccatagcctctttgaaacacatagatccggcaatgtggaatgccatctctgatgaatcgacctcatggtaagatccatcgtatactgttgcatggataccaactactgggaatccaccaagagagccggcctttgtagcctcctcgataccttcgccgattgatgggatgtactcctttggaatagcaccaccgacaacctctgaatcgaacttgaaaagttcttctccattggcatccattggctcgaagcgaaccttacagtgtccgtactgtccacgtccacctgactgcttagcatatttgtattcctgatcaacagcctttgtaaatgtctccttgtaagcaacctgaggtgcaccaacgtttgcctcaaccttgaactcacggagaagacggtcaacgatgatctcaaggtgaagctcacccataccagcgatgattgtctgacctgtttcctgatcagtatgagcacggaatgtaggatcctcctctgcaagctttgcaagagcctcacctaacttaccctgtccagcttttgtctttggctcgatagcgagctcgataactggctctgggaactccatagactcaaggataaccggatgctgctcatcacagattgtatcacctgttgttgtgaatttaaatccaacagcagcagcgatatcacctgagtaaacctcatccaattcctgtctcttattagcatgcatctgaagaatacgtccgatacgctctttcttatcctttgttgcatttaatacataagaacctgccttacattttcctgagtaaacacggaagaatgcaagctttcctacgaatggatctgccatgatcttgaatgcaagtgctgagaatggctcatcatctgatgaatgtctctcaatctcatttccctcaagatctgttcccttgattgaagggatatctgtaggagctggcatgtactcaacaatagcgtcaagtaacttctgtacacccttgttacggtatgcagaaccacaacatacaggtactgctgtacactcacatgttgctttacgaagaaccttcttcatatcctctacagatggctcctcaccctcaagatactgcatcatgagatcgtcatctaactcacagattttctcaatgagctctgtacggtactctgcagcctgatcagccatatctccaagatcatcagtaactgtgatatcgtcacccttctcatcattgtagatataagccttcatctcgaaaaggtcgataattcctttgaaatcgtcctctttaccgattggtaactgaagtacgatagcattttttcctaatcttgtacggatctggtcaacagctccgtagaagtttgcacctaagatatccatcttattgatgaatgccatacgaggtacattgtatgtgtcagcctgacgccaaacgttctctgactgaggctcaacaccaccctttgcacagaacacaccaactgcgccatcaagtacacggagtgaacgctcaacttctactgtgaagtcaacgtggcccggtgtatcgatgatgttgatacgatgctcaagtgctcctggctttggtttagtgaactcttcaagtgtccagtgacatgttgtagcggcagaagtaattgtaatacctctttcctgctcctgctccatccagtccatggtagcagtaccttcatgagtatcaccgattttatagttaataccagtataataaagaatacgctctgtcagtgttgttttaccagcatcgatatgagccatgattccaatatttctggttctctcaagtggatattctcttccagccaaggttttttcctcctatatttagtgtcctatgcacaaccggactctgttacaaatccggtccgctgcatgaatcaaaagcaaagctgtaagcttcttacagaaactagaatctgtaatgtgcgaatgccttgtttgcctctgccatcttgtgcatatcttcttttctcttaacagatgcgcctgtgttgttagctgcatccatgatctcgttagctaatctctcagcctgagttttctctcctctggcacgtgagaatgctgttaaccaacgaaggcctaaagcctgacgacgatcagggcgaacctcgattggtacctgatatgtggcaccaccgatacgtcttgcttttacttcgagagctggcattacattgttcatagcctcttcgaatacttcaagagctggtcttcctgtcttctcttctactgtagcaaatgctccgtatacaatcttctgagctacgcctttcttaccgtctaacataatgctgttaacaagctttgtaactactttgctgttgtacattggatctgctaatacgtctcttttctgagtatgtcctttacgtggcacgttacttccctccttaatcatgatatttgtggattaattcatcggtactcacatgtgtctctctaatgtgttcgtgcggaattgtattcataaagtgaaatcctgcatctgcaggtctaatcccaacactaacctactttagttctgtttgtgatacacaatgttgctaaattatttagcagcttttggtctctttgcgccgtacttagagcgagcctgttttctgtttgcaacacctgcagtatctaatgtaccacggatgatatggtaacgtgtacctggtaaatccttaacacggccaccacgaatcagaacaacgctatgctcctgtaagttgtgtccctcaccaggaatgtatgaagttacttcgattccgtttgaaagacgaactctggcaatctttctaagagctgagttaggcttcttaggagtagctgtcttaacagctgtacatacaccacgcttctgtggagaagaagtgttgattggcttcttctgaagagagttaaagcttctctgaagagctggtgctgtagacttctttacagatgtctgacgtccttttcttactaactggttaaatgttggcattattttcacctcctgttttattttaagcagtgcaatcttatgcacgctaaaatattatacaaatccttgtctgttttgtcaagaccaattttgttttcaatataatacaagaaagaagtccggtttcccggacttctttctttttggtttgtaacagcttctgtagcttaagtacaaacatcagtaattattcttcatcaactgattcagcatctgtatcaatgactccgactgcctcttcctctgcgaaatccgcaaaatcatcatcatcaaaatcaagtgtatcctcatcgtttacatcgctgtcaagcttgatattacgataaatcttcatacctgttcctgccgggatgagcttaccgatgattacgttctccttcataccgataagcggatcaaccttgcccttgattgctgcctcagtaagaacctttgtggtctcctggaatgaggctgctgacaggaatgagttggttgcaagagatgcctttgtgattccaagtaatacctgtgagccaactgcaagctccttaccctcttcctcaagcttctcgttgagctctaagaagtcaagggcatcaaccatgctgcccggaagtaaatctgaatctcccggctcctctacgcggatcttctgtaagcactgacgaactataacctcgacatgcttatcgttaatctcaacaccctgtaaacggtaaacacgctgtacctcgcggagcatgtaatcctgaaccgcacgaacgcccttaatcttgaggatatcgtgtggatttacagaaccctctgtaagctcgtcgccggcctcaagctcctgtccgtctacaaccttgatacgtgagccgtaaggaatgaggtaagcctttgtctcgcctgtctcgttgtttgtaacgataacctcacgtttcttctttgtatccttgattgtggcagttccgccgaactctgtgataatagcgagtcccttaggcttacgtgcctcgaaaatctcctctactcgaggaagaccctgtgtgatatctccaccggcaacaccacctgtatggaatgttctcatggtaagctgtgtaccaggctcaccgattgactgtgctgcgatgataccgattgcttcaccaacctgtactgcctgacctgttgcaaggtttgaaccgtaacacttagcacatactcccatgtgtgaacgacaggtaagcactgtacggatcttaacctgtgtgattggattaccattctcgtcaacaccctctgccataacctttgctgcacgctttggtgtaatcatatggttggccttaacgattacattgccatccttatcgcagattgtattgcaagagaaacgacctgtaattctctcctgaaggctctcgatttcctctcgaccctccatgaatgcctttacaaccattcccggaatctcacgtcctgtgcctgcacagcagtctgtctcacgaacgatcatatgctgtgaaacatctacgagacgtcttgtaaggtatcctgaatcagctgtacgaagcgctgtatctgaaagtcccttacgagctccatgtgctgacatgaagtactcgagtacgtcaagaccctcacggaagcatgacttgataggaagctcgattgtacgacctgttgtatcagccatgagtcctcgcatacctgcaagctgtttaatctgcttatcagatccacgggctccggaatctgccatcatgaagatgttgttgtacttatcaagacctgtaagaagtgcctttgtaagggcatcatctgtatccttccatgtctcgataacctctttgtaacgctcctcatcagtgataagtccacgcttgtactgtcttgtaatcttatctacagtgtcctgtgcatcagcgatcatctgtggcttctgtggtggcactgtcatatctgaaattgaaactgtcatggcagcctgggttgaatacttgtatcccatagccttgacattgtcaagaacctctgctgttgttgtagctccgtgtgtgttgataaccttctcaaggatctgcttgatctgtttcttaccaacgtggaactcaacctcaaacttgagtgcattctcagcctttgatctgtctataaaaccaagatcctgtggaatgttctcattgaatatcaaaagtcctactgttgtctctgtaaaacctgaaacctctgtgccgtcaggaagctttactgtacggtgtacaaagatattctggtgaagagtaatctccttgttctcgtaagcgagcattgcaagattaacacttccatagtaacggccgagaagatctatcggtctgcaaagcacacgacggtttccgtctgtaacatcctcaaaccagatgaggtcatataagccaagctcagcctttcctgtattttcatcaggagttgtgagctttctaagctcctcaatatcattgtatacagtgtctgatgacacctgtgcaaccatctttggatcatccttgtaatcagcgagctttctcattgttaggtagtaaactccaaggatcatatcctgtgaaggaacggctacaagtccaccatcggaaggcttaagcaggttgttaggtgacagaagcatgaatctgcactcagcctgtgcctcagcagtcagtggaagatgtacagccatctgatctccatcgaagtcggcgttgaacgctgtacatacgagtggatgaagcttgattgccttaccctctacaaggattggctcgaatgcctggattccaagtctgtggagtgtaggagctcggttaagcataaccggatgctctttgatgacatcctcaaggacatcccatacctccggctgaagtctctcaaccatcttctttgcactctttatgttgtgtgcggttccgttagcggcaagctccttcataacgaatggcttgaaaagctcgatagccatctcctttggaagaccacactgataaatcttaagctttggctctacacagataaccgaacgtcctgagtagtcaactcgctttccgagaaggttctgacggaaacgtcctccctttcccttgagcatgtctgaaagagacttaagagctctgtttcctggaccggtaacaggacggccacgacgtccgttgtcgataagtgcatcgacagcctcctgaagcatacgtttctcgttacgaacgatgatatccggtgctccaagatcaagaagtcttctaagacggttgttacggttgatgattcgtctgtaaaggtcgttaagatcacttgttgcgaaacgtcctccatcgagctgaaccattggacgaagatccggtggaataacaggaataactgtcataatcatccactcaggcttgtttcctgactcacggaaagcctctacaacctcaagcctcttgatgatacgtgcacgcttctggcctgtagcattctcaagctctgccttaagctctgccgaatccttctcaagatcgattgctgctaaaagctcatggatagactcagcacccattcctacacggaatgctgagcggccataagtatcgcatgcctcctggtactctgactcgttgagaatctgcttgtatgcaagctttgtctcgcccgggtcaagcacaatatatgaagcaaagtacagtactctctcaagtacacgtggagataagtcaaggatgagtcccatacgtgatgggatacccttgaaataccagatatgagatacaggagcagcaagctcgatgtgtcccatacgctctctacgaacgcttgactttgtgatttctacgccacatcggtcgcagacaacacccttataacgtatcttcttgtatttaccacaatgacactcccagtccttcgttggtccgaaaatcttctcgcagaaaagaccgtctttttcaggctttaatgttctatagttaatagtctcaggctttttaacctcgccatgtgaccactctctgatcttttcaggagatgctaatccaatctgaatcgcatcaaactgcattgcctgattattttctatattatttgtttctggcattttggcactcccttctaattattcttcgtcatcaagaacttcatcagcaaaaatatcgtcatccgctgtctcaggagactcttcctcttctatgtcaacaagctcttcgttgtcatcaaattctttctttgagaaaccatgctctgcgaatgactcactgtcctcgaatgcatagtccttatcgtttccgataattgagttgatatctgtattaccgtactcacttgtctcgataagctcaacctcttctctgttctcatcaagtaccttgacatccagaccaagtgcctgaagctctttgagaagtaccttgaatgactctggaataccaggctcagggatattctcacccttgatgatagcctcgtaggtcttgacacggccaacaacatcatcggacttcattgtaaggatctcctggagtgtatatgcagcaccatatgcctcaagagcccaaacctccatctctccgaaacgctgtccaccgaactgtgccttaccaccgagtggctgctgtgtaactaatgagtaaggacctgttgaacgtgcatggatcttatcgtcaacaagatgatgcagcttaaggtaatgcatgtgtccgatagttgtctttccatcgaagcactcacctgttctaccatcacgaagctgtacctttccatcctttgaaatcggaacgcccttccataagcttctgtgagctctgtttgttgaaaggtattccataacgtcctcacggagtgtatcaacatatttatcatagaagatttcagcatctgcgctccagtatggatgctccgcctgtaaatccttttcaagctcttccttatcgaacggaagatttacgtaatcatttgcaagctcaagtgtatcctcgatatctacctcgttagctccgtcaaatacaggagttgagatattgaagccaagtgcctttgcagcgagactcaggtgaatctcaaggacctgaccgatgttcattcgtgaaggaacaccgagtgggttaagtacgatatccagtggacgtccgtttggaaggaatggcatatcctcaacaggaagcacacgagaaacgacacccttgttaccgtgacgtccggccatcttatcaccgacagaaatctttctcttctgtgcaatgtagatacgtactgactgatttactcccggagaaagctcatcgccgttctctcttgtaaataccttggcatcaacaatgataccgtaagcaccatgaggtaccttaagtgatgtatcacgaacctctcttgccttctcaccgaagatggcacgaagaagtctctcctctgctgtaagctctgtctcaccctttggtgtaacctttcctacaaggatatcaccggcacgaacctctgcacctacacggatgatacctctctcatcaaggtccttgagtgcgtcgtcgccgacaccagggacatcacgtgtaatctcctcaggtccgagctttgtatcacgtgactctacctcatattcctcgatatgaactgatgtatacacatcatactctacgagacgctctgaaagaagaacggcatcctcgtagttgtatccttcccatgtcatgaatccgataagcgggttctttccaagagcaagctctccctgacttgttgaaggaccgtctgcgataacatcgcctgccttaaccttgtcacccttaaatacgataggtctctggttgtagcagtttgactggttagaacgagagaactttgtaaggatatactctctcttgtttccgtcagtctcttttatgataatgcggtttgactctgaagataatacctctccgtctgcctttgcaactacgcagacacctgagtcaactgcggcctttgtctcaatacctgtaccaactacaggagcctctgtggtcagaagcggaacggcctgacgctgcatgtttgatcccatgagggcacgtgtagggtcatcgttctgtaagaatggaatcagcgctgtagctactgagaataccatctttggagacacatccatataatcaaatgctgacttatcgtactcctgagtttcctctctgtaacgacctgaaactgagttacgtatgaaatgtccttcggcatcaagcttctcgttagcctgtgctacgtggtagttatcctcctcgtcggctgtcatgtatacaacctcttctgtgactaccgggttcttaggatcagtcttgtcaatcttacggtatggagcctctacgaagccatactcattgattctcgcatagcatgcaagtgagttgataagaccgatgtttggtccctcaggagtctctacaggacacatacggccgtagtgcgtgtaatgtacatctcgaacctcgaatccggcacggtctcttgaaagaccaccaggtccaagtgctgataaacgtctcttgtgagtaagctctccaagagggttgttctgatccatgaactgtgaaagctgtgaagaaccgaagaattctttaacagcggcagttacaggctttatattgataagtgactgaggtgaaattccctctaagtcctgtgtagtcattctttcacgaacaacacgctccagtcttgagagaccgatacggtactggttctgtaacagctctccaaccgcacggatacgtctgtttccaagatgatcgatatcgtcatctgttcctgcgccccactctaagtgcatattgtagttgatagttgcgaagatatcctctttagtaatatgctttggaataaggtcagatatatctctctttatagcctcgattctgtcctcaagagaatcatactcctcgagaatctgagcgagtaccggatagtaaacaagctcagtaacaccgatagacttaggatcctcaagctcaggaatccagcttctgatgtcaaccatcatagaagaaagaatcttgacatttcttgtctctgtctgaatccataaagcaggaacggcagcgttctggatctgtgtagcaagcgcacggtcaacaacagtacctgcctcagcgataacctcacctgtagaaggatccactacgtcctcagctaaaacctgtccactaatacggttctttaaagcaagcttcttattaaacttataacgtcctaccttggcaaggtcatatcttctaggatcgaagaacattgctgtgataaggctctctgcactctcaactgaaagcggctcgcccggacgaatcttcttatataactctaataaaccagcctcatagcttccctgtggctcacgctctgtgattgcagggtccttgctgaatgatgcctgaatctttggctcatctccgaacatatcgagaatagcctggtttgtacctactccaagtgcacgtaaaagtactgttataggtaccttacgtgttctatctactcttacataaaaaacgtcgttagagtctgtctcatactcaagccatgcaccacggtttggaataacagtacaagaatacagggtctttccgagcttatcatgagcaattccgtaataaataccaggagaacgaactaactgactgacaataactcgctctgcaccgttgattacgaatgtaccggtctctgtcattaaaggcagatcacccatgaaaatttcatgctcattaatctcatctgtctctttgttgtgaagtctgactttaacctttaaaggagctgcgtatgttgcatctctttccttgcactcaggaattgtatactttacatcatcttcgcataatgtaaaatctacaaaatcaagactaagctttccgctgtaatctgtgattggagagatatccgcaaaagcttccttgagaccttcgtctaagaaccactgataagaatccttctggacctcaatcagatttggcatctgcagaacctctttttgtcttgagtaactcatacgcatgctttttccggatgtgaccggacgtattctgtttttctccattgacgtttcacctctcgtttttattttaatctagcaagtatctagataatgattcaaaaaccaccccagttactatatcttgtggtttttctcttgtgcacatatttgcgaatgcattttagtgtaatttacctattgacaaatttgcatcatttaaaaaaatgcataaaaatgccactgcaccacaatagtgcaacgtatactatacaacaaatcaccgacaattgcaagtactttttttattttttcattcgccgtcggataggctacgggcagaggtcccaaaaatgctcaggcattttcgggacgcgctccgactgtcgcgcaataaaaacataaaaaagagccaaggcgcaaatagaatttgcccttggctcttttttatgtttttactccgctcgtagcctatccgactatttaagagtaaccttagcaccctctgcctcaagtttagccttagcatcctctgctgaagccttgtcaagctgctctttgataacctttggtgcgccatcaacagcgtccttagcctctttaagtccaagacctgtgatctcacgaacaaccttgataaccttaaccttgtttggtccaacctctgtaagctctacgtcgaactcagtcttctcctcagctgctgctccgtcagctcctgctgctgcaactacaacacctgctgctgcagaaacaccgaactcttcttcacaagcttttactaaatcatttaactctaatacgcttaactctttgatagcatcaataaactctgctgttgttaactttgccattataatttcctccatttaaaaatttaattatgataataaggttcaaatataatatttgaattattctgctgctggagcttcctctgcagcatcctctgctggtgctgcctctacggctgcatctgcagcgccaccctgctctgcgatctgattgagtacacgagcaagatttgtgataggtgactgaatgcttccaagtaattttccaagaagctcatctctgctaggtacagcggcgattgccttcataccctcagcatcataaaatgttccctcaactacacctgctttaatctctaaagccggagctgttttagcgaacttagctaagattctagctggtgctgttgcatcctctgctgatacagcgaatgcgcttggtccttcaaggacatcctttaatccctcgaactctgttccctggattgcacggtttactaaagtattcttgtataccttgtaagtcacaccggcttctcttaactgtttacgtaactgagtatcctctgctactgtgagtcctaagtaatcaacaactactactgactgtgcaccattgataacaccggaaatctcatctacgattggctgtttaagttctacctttgccacgattcatttacctccttttagattttcgcataaaagacatgaggtatttgatttattaatcaaagaaaccctcctgcctgtcgacagaagggtacaagtcaaaattcaagataaatctcgaaaattccctcggtaggttctacgtttacgccttgcggcacctactgtcttcggcaatatgcattgcaattatatcaaactatattacggatgtcaattactttccgcaaaacttttgcttggcgtttgataggtcttgtaaattgttttactgtaactgtttaactatcttactgtgtaatcttaaccacgtttaacttaacgccaggtcccattgtagatgtaagagttgcgctcttaatgtactgaccctttaagctagcaggttttgctttattaattgcacccataagagactggaagttgtcgtttaactgctcgtctgtgaaagatgcttttccaactggcacatggataatgtttgtcttgtccaatctgtactcaatcttaccggctttgatatcgttaacagcttttgttacatccatagtaactgttcctgcctttgggtttggcattaagccctttggtccaaggacacgtcctaaacgaccaacaacacccatcatatcaggtgtagcaactacaacgtcgaagtctaaccatccctcgttctggatctttggaattaactcctcgcctccaacgaagtcagctcctgctgcctgtgcctcgtcaaccttagttcccttagcgaaaactaaaaccttaactgtttttcctgttccgtgtggtaatacaaccgcaccacggatctgctgctctgcgtgacgtccgtcgcagcctgttctaagatgaagctcgattgtctcgtcaaatttagctgtagcatttttctttacgatagagatagcgtcagcaacatcgtactgctctttcttatcaaatgccttaacagcgtcttgatacttctttcctcttttcatgaaaaaataacctcctggtggtaatatcgggagagggccctcccacatttacgtttctttgttattatttttggttgcataaatttgcaactattttaggggtatgttggcctcgctaagtgttagtcaaccacttcaacacccattgatcttgctgtaccagcgatcatgctcattgcagactcaagtgaagctgcgtttaagtcaggcatcttaagctcagcgatttcctgaacctgtgcctttgtgatcttagcaaccttcttcttgtttggctcgcctgaaccagactgaatcttgcaagctttcttgattaataccggagcaggtggagtcttagtaatgaaactgaaacttctgtctgcatatacagtaataactacagggataattaagtcgccctgatcggctgtctttgcattaaactgctttgtgaactctacgatgtttacaccgtgctgtccaagtgcaggtccaactggaggagctggagttgcctttccagcagggatctgcaatttaatgtatccttctactttctttgccatttggaattgcctccttaatttgttttcttaacatctgcgaaacttacttctaccggtgtctcgcgaccgaacagctctacattaattgtaactgtctgcttgtgataattcatagctgtgataacaccgactgtatccttccagacaccgccgataacgactatcatgtcaccctcagcaaaatcaactaccacgttttccgtcttaatacccaaaggtctcatctcggcttctgtgagaggaaccggtttgcttcccggacctacaaatccagttacgcctctggtatttcgtacaacgtaccatgtatcatcattcataatcatatgaataagaacatagcctggaaacatcttcttggaaacctgtttacgaacaccgttcttcacctctgtgacgtcctccaacggaacacgtacttcaaggatctggtcctcaagatgtctgttttcgattgttttgtcaatattagctttgactttgttttcataacctgaataggtatgaactacataccagttcgcttctgtcataatcactttgcctccgttttaaaaatgtaaaccaataaggaaatctacgccctgctggatgccccagtcaagaagcgcaataataagaccggtaactactgaaaccgccagtactgcaatggtctgtctgatgaccgattgcttctcaggccagataatcttctgaaattcagctttcagacctgaaaaccagcttgtttttggagccttttcgactttttcattctgtcccataatgtactccttcactcagttcctagactattttgtttccttgtgcattgtatgagttctgcagaatctacaatacttcttggtttccattctgtccggatgagtttttttgtcctttgtcatgttgtaattacgacgctgacattctgtgcacgctaatgtaatctttgtacgcacgacttccacctccgtttaaattctttgttgtttgtacccttaaaaaaaggcataaaaaaaagacctatttccaagcctgtatactatatcacagttgagccgtaaccgtcaatagctattttaaaatttattgtaaattcttttgaacagtgccgctgtctgcaccttttttgtgtccggcagcaattagtttttataaatcttacagatacataactaaatatagtacatttatctgaatttttcaagtattttgttgttgtaaatcctcaattatgacgatataatatatgtgtataaataggatttgataattaaaaattttacatagcttattatagctgcagttaagcattagtaatcgcagctatacaatataatatttaaaggattaccatttaacggattaaacgattttcacggatgaaaggaggggtctttatggcaaagatagacagtgcctatgcttactatgccagcacttatgccaataaagaggtatcgcgctatgattcgcacaagaaaagcgacctgcgcaagatatacaacagaataataaagacaaataaagagtcccctctgtacaagatttccaatatgtccgaggccaagaaatatgctatcgatataaaggaaagctctaaggccatcttaaatgccgtggattcgctttctgataaatacgcagactcctctgactccttccagaagaaggttgcggagtcatctaatgaggatgctgtaggcgtgcgctacgtgggtgacggctcagagaataaaggagcagacggctttgatatagaggtcaggcagctcgccgcaccacaggtcaataccggcagctacttagacagcaaggccctgtcctttataccgggcagctattcttttgacataaataccaatgcatcatcctatgagttccagttcggagtgagcaccggtgaaacaaacggcgaggtgcaggacaagctcaagaggctcataaacgcatccggtcttggcatcgaggcagacatagtccatgatgactcaggcaaggcagcgcttcagcttacatcaatgcagacaggtctcagcgagactgaggattctctctttagtgtggctccgtcagctaacgcagagtccataagcatgatgaagcagctgggtattgataaggtatcatcccctgcccacaactctgacttttcgctgaatggcaccgcgcactcatccttgtccaacacctttaccatcaataatacctttgagctcacgctcaaaaagccgaccacagatacaggtgccgcagccatcggttttaaggccaattccgatgcagttgccgacaatgtgcagactctggttgacgcatacaataagatgatagacgtggcagatgattattcagtgaacgactctgcagatgccacaaggctgcttcgtgatataagctccatcacaaagggctcacagtcaaagctttcctacatcggtctcatgacagacgatgacggcaagctcactattgaccgcgatatcctcgccggtgcgcttagtccggacagagctgatgacaccttcaacactcttacagcactaaaggatgcaataggtgacaaagcaaaatctgtgacagtcaaccctatgaactatgtgcagaaggttgttgtggcatataagaatcccggacacaatttcaacacaccatatatttcgtcaatttattcaggcatgatgcttgacagctacgcataaacggctgttgtacccaaatcagtacaacagccgtttttttatttttttataatagtggctgcagatctcccaccattttttcctccagtgtcctgagcctctctgcaattgccacactctttgaatcagcatcgcgatattcattgagactgccgctgattgtctctatgcccatattacagccctccgtcagtagctttgctgcctgggactgatcatcattcactgccatcttcattgctgtctgcagcttcgcagccatctttgcaaacacacccggttccttaatatctgcacctgctttgtcaagcatatccctgcaatccactgacagcccggtgtgctcatcatagtacttgtctatcagctcacgaagctgcatgtcatctgtgtgttctcttatatcatccatgctctcaagtgccatcttacagcccgctatgcaatcctgaagcaagagcaccgaatcatgattttctatatttctgctcataaaaacctccatacttcttttctatttagtatggaggttttcatgaaaaaatattcactacacaatcggaaactcaagcttcacccaaaacttcccacgttctcgtttaaatctcatgcttccattcatgcgctgcatcatcgcatccacgctcttaagccctatcccggcacttttaagaagcgttttattgtcacatacgccattgccaatttcaacgctaaaaatttttttcgtaaaagctgttttcataacaacaggcttcttattgtccgcatatttatatatattatccgtcagattggaaaatattctggtcaaaaatgccatattaacagcaacctttacctgcttaaagcttattccttctgcatcaacctcataattgcttttcataagctgagcacacacatctgagaggtaatctccaaatatatactcaacatccattgatgcatccaattcaataggtctttgtgaaccggcaattgaaaaatccagcagattgtctacctgagtcctgatatccaataccttttcacttataaaattaagatttttcatattctcggcatatggttcgttctccagtttcattacatcaacatatgtcataacaccagtcaatggcgtacgcaggtcatgagccatattacgcatcagttcatccttttcctgtcgcgcttttttctcctgttcctgtgatgcttcaagctctgtttgatagcccgctataatttttctgatgcgtagatacacaaatacaattcccagcataagagaaaatcccacatcaaaaatcataaaagcaatataatatttttccgtaaatcctgtatatataaatacttccgcctcaatatcggagaactggacaggcagctcatagcttcctgtaaatcggtaatcatacatatttttagccggagatataagcttatctacatttgatttattgtatattaccttccccatttcctgaacactataaaacgcaacatcatgctccgacatccattcatcatattgctcgacatctgtagtacttatatcattatcagatacatattgttgaaactcgtctatatatggcttttcattatagtatatcatacaagatccagcttcaatataatagctcaacaaatcaattcccagatagtataatagtccaaaaacaacgcatgtgcctataatcgcaattgcaaatgtcaaagacagcttttgttttactctctttaaatcatctctcaaaacggtatcctcttccccattctgtgtgtatacatgcatcgccacatgcttttataagcttattcctaagatttttaatgtgtaccataacagtattctttgcattatatgtaaaagcctcatcccacaccatctcgtatatcatctcaatcgtatatatccggtccggatttttcattagcagttttagtatctcatattccttcccggttaattttatctcatcacaattaaactcaaccttatttcgattcgtaaacagtttaagtccatctgcctctatagattcatccttgtttttacgatttacacttccgctgtcatatacccgatatcgtctgataagagctttaacctttgaaataagctccatgtttgaaaatggcttagtcatgtaatcgtcaccgcccacttcaagcccttccagcttatccagctcttccgattttgctgataaaaacaatatcggaacactgtgtctttcacgcattctcctgcaagtttcaatgccgtctaactgcggcatcattatatccattattacaaggctgaacgattcatctattttttctaaagcttccacaccattttgtgcaattaccacactataatgctgcaattcgagaagcttttttatgccactgtatactgttttatcatcctcaacaacaagaattttgtccattatatgctcctatcatattatacatgtttattacatcaaaaagattataccacataaccgctcctaattattccttaatgtgcgcaaacccttattagcataaatgcagcttccaatcatagttattaaaataacgctaatttccaaaagtccgattctatacacaaattgccagatattcatttcaaagttccatatatcaagtgaaaagcttttttgaaaatttgaaatctcacaaaattcaacaaagtatttaaaaatattgacagaaaatctattaagcagtcccaatgtcaatatttctgcgcccacaagtgccggaagagttatcatcaaaatctcatataacagaatttgaattgtcctaaattttctctgtccaagtgtattgtatattgcaatcatttttgagtgtcctttaagccataaaacagtcagtaacgacataaccacaacacatacaatatacataacgctcaacgtcacacttgtcatactttttaacattgatattacatctgtcatttgcagttcctcattcaaaacctgattgacaactgccgaattcggaacattttgaaacattttactcatatcatcatataaaagtgatgtacttttataatctgtgctgaaaaaatttatcccataacagcttgcttcattgtttaattctacatatgaattataatcagtaaatactatactgtcagccacttctttatagtagccatcgcttacctgtgtctttggcgtatttattacagtatatattccaatcaccttaatacttattgtattattttcatactgtatagatatattactgccaattgacaggttattttcagaagcgagcttatcggatatcattgcccctttatcacctgacatcggatattttccttttgaaatcttaaagataccactactgaaatattcattgtaagaagtatttatgtttccactgacatatattttatttttctcaaaatcactttgtttttctgtatatggtacattttcaaaatctgccgcttcacatataatatcacttgtaaatgcattattatatcctacaacatttttattattatctgcatattctaaaatatctttccaatcatctaaagtagaaaaatcgtctgattcaacaagaacacaacaccctgccatatctgcaaaagatttgtaaaagctctctattgccgaatctaaaaatgttgcaattccgcaaaacagtgtcagtacaaatatgcaaatagcaattagtatattccgccccggtctccctaataattctttgcatgcctgccaccatttattcctcatcgtcatctcccatatcatagcaaatatcacattttttctttacataatccgagtgggttactactataacacatctgtcctgttcatgagctatctgctgtaacaattcgacaatttttcttcgattttctttatccagattacctgtaggctcatctgccagaatatattttgcatctgttatcaacgccctcgctattgcaactctttgctgctgtccacctgacaattccgtaacctttctggttatctgactatcatcaagtccaaccatcactaggctgtctctacacatttttatcaattcttttttgggtacatcaggtaagcttatctgggctgcaaccattacattttcaagagaagtcatataatcaaataactgataatcctgaaaaaccaatgatatactattttggcgcagttttcttccaccaatgttttgtatattttctccatccagcaaaatttctccctcatccggtttttctaaaccggcaagtaaagataagcacgttgtctttcctgaacctgacggaccaaatattccatacatttctcctatttcaaatctgtatgtaactttatccagcacatgcacaatttccttcttagatttatatgcatacgatacattaatcatttccaacatatttaccactatcccttcgaatttaacagtttctttgcattttcttcaacagttgttacaacaggcagtaccataaatgcaatccaattaaccaacgaaattattaatagaattataatatttttcagagtaaaaaaagcactcatttctatacgtacctcaaagccttgaaatattcctggtatatcatatccacctatagctctgtctgtactattaattatgacattcttacctataccacttataatgctacatattaaatcgccaagcacacagtataatagcgcacccaaaagtaatccactaattgcatatatcattcctataaatgcaaatctacctatacaccattttcttgaccttccgagtaccataaaaagtcctgtatctttttggtattggatagtataaaacgagaaaacgattaacaaaataatttcacccattataattatcatccagcaaattatttttgatgtttttcccatcaatcctacgactttacattctgaatcgagataattagaagtattatcatatatctccacattatctccatacattttctttaattgtttttttactgcatctatatgctctatcttatcaatatacacttcgcttcccgttgacgctgtgtactctaaccctagtaactctacaatataatcataatctacatatatagaattatatggactatgtatgtataccgaggttccctcttcatttgaatcatatatttcgaaatcactgtccactttataaattccgcatatttgtaaagacgttgcctccgattggtctcctatagtatatttaacttcatcccctaccttaaggttattttttttcgcatatcgctgttctacaataattcctttattttcatatgttggaaattccccttcaataagagatacatttttttcccatgaaaacaggctatattgctgcacatccatatttgcaacaatcaccattttgtcagcccgattgcgcacatctttattctccggatctattcctttatgttcctttacattctctgtatccaccggatctgcaatcagctctctccatgccccaagtcctgttacatattttacttttctgatttcatcataatcactctttgtaaaacctccattatcatcctcaattactaaggctgccccattatataaatatgcatctctctcagatttttctgaggcattgcttaatagcaggccaataatttcacccaggattattgtcgcgatgatcagtatgataatcaaagattttattttatttctttttatatatataatagctgtttctatcatatcccatctcctcaattatcttactattgccgtttcagatatccttttaagtttttggatttcaacatcggcatcaaagaaaagatatttaccattcatatacactagatttgcaactgctttatcatcctgatacaaggtaatataaccatcatcgttccatttccagattcccgtttcaaccttatcagtattctctatctccatttcatattcaccctgtttttcatcattatcatgtataatggctaatttattggtactcttaacattttgatactctgaaaaatcaaaagttccataatagagttccactgtcagatgatttttttgttgtaatatgttatatgtaattaatacactgattacacagacacaagcgacaatcgctgcgcagataataatctgttttctatttttttccactacatacttcccccttctttattgttcaatcaatgccggctttattctaaccgtttgatacttcttgctataaacgatatataataccacttttagtgaataaaatcctcatttatgtgaagttttcaaggtacaaatttatggttataaggtatctttaacagaataccttttgaccctcaaatcatatatataatagctgtttctatcatatcccatcttctcaatactacctgacattaaaaaaagccatagacatctatggctttacaatactatatacatataaagaattagctgaaaaatcatttaagaattataaataattctaaagaaacctaaagattcacatacccattttttatactataaacctggtcacacagaatttctatgtcttccttatggtgacttgttataaccataatagcaggttttttattcacatattccctaaacattattctcatatcctgaacagactgttcatccagtgcgttcatcggctcatccaagagcaataccttaggctcttccataaaagcctgagctattgccagcttctgcttcatacctaaagagaacttacgataaacctttttggaatccggctcaaggcccacctgtttgagaatttcattgattctttcttctcctgttttcttattaatttttgccagtaaaagtaaattttcctttgcagtatactccggcatgaagcctatgcagtccagcactattccaacatcctttgcatactgtccttttttcagagggatgcctccgtattttattattccatccgacggctccattaacccagtcattatcttcaataaaacactttttccactaccatttcttccaacgagaccatatattttcccggattccaattttaaatttacattttccaacacggtctgatttttaaaattctttgatacattatccagctctatattcatatattttctgccttccacttacgtaaaattatatactcttgtttattttttaatattacagcaacgcccgttcctataacaagacactctgccatttgaaataccatacactcaggctgagatgtcatatgtgaaatatacagcccctgtgtaagcggaagccacgaaaataatgttcctgccacaatatggcatatagtaattattataaatcccatatgtttatctccggcttcatgcaaccagcatagaaataccagcagtaacaaggctattgtctgtaaaatcatattactcatttccattatcaaatttacatttattaccgttcccgaaataaatgctattactatcattcccactccgtaatacagataagtacataccagaaatattatcgccagatgcttcatccagctaattgtatttccttttctcaaggcaaactgaatatagtaaaacgaaaagttctttgtcaaaaaataatacaataaaatccagattggcatttgataaaacaaatatagcagtaaaaaaatatcaagctttttaaatccggcaaaatagtctgtaatgcctgacatatattgttttgaaacaaatccgtatatgctccatataacaactgctgccataaacgtaagaccataatatgacttaacacatattgcaatcagtcttttaaaaaagttgagtataacggctctataaaatataaccattataacaaacgcaatactcacagaccaataaacaatataaaagctatatgtttttacatctgtaaccatcaaatgggcaatccatgattttcttccaataaaagaatctttaaagcttatcctattgctgataacaatatttataagcaggcatacaatactgcagatattagctgcccatcctgtatttatcaatttgttaaataaaatggtaacacaacccagcagccagtaaaataacaataagttgccaaatagctgatacacttttgtcacatgaagcatctgcgactgaacattataaaaactatttacaacagcaatcatattaattaccacccactggataactgcaatgataactgcatatttgaatgcatacactacttcaatgacatttgccctatgttcacttccaatccgcaatttaagataaaaattattccgtgtaaccgccaataatccggcaatgctccatacaattaaaatcccgctgacaagcaatattaaatatctgtctccaacgatatttataactgcattggcatatgaatactcctgatatccggcatcacattccatacaataacgaacatattcaaattgcatatagctaaaaataatgaatatagttattaataaatgcaaccatctacttttcattattttttactcctaccgcaaacaaaatgataccggttaaaatcaatatacctgacataattaatattatcggaacagatgcccatgcatatccattaggcgcaaatattaaaagcagatcaaatctgttatccggtatcaatattgccatggctatgcaaaggacaaatggcagtatcagtgtcagaaaagtgtttttaatccatgccgatatgccgattgcaaatgtagcaaatgtaactcctgccaataaaacaaacgtaccaagtaaacaaacatatgctatagtattcgaggctgccagttcaggatggaacataataactgtctctccctcttttatattcaagtaagccttagttccatactgaaaatataaatgcagacaatatacaacatacggaataagcaaacccaagccgccaagtattgcgttttgtattaatgttacagcaacatacctttttcttgacattttttgcaggcgcagcttcaaatatccgcttctatattctctgacatatgatattcccataggaagtgctgccagtatcggaaagaggattccattccagccactgcttccggatcccatactaagtatcagtctgtatatcatatgatcagaataagcagttgcagctctatatgtatatgcgtaatttgcttcttcataaaggagcagtccaataacaatagaaataataaaccccgaatacttttttatatatagcatattttcctcttccgttttcatttacttattaatcgttcctatagatatctacaaaaaaatcgtatcacaatattttaaagaaaaagaaaggcacttctgaaattttctaaaaatttctaaagatttctgaagtttatagttcagttcgtaatcggaaatcgcaattttacataatagcagtattcttttgtttcgtaaattgctctgccatgcatacgtctcatcaacagctcaacattttttagtcctaatcctgtactctccaataagcttttttccttacacaccgtgttgcttatgcatatttcaaatatattttttgaatatactgtttccatgaccacttgctcatcaatatcagcatacttgcaaatattattagtaaggttactaaatattcttgatagtaaacttccatttacagcaactttaaccttttcccaataaatgccatcaatattaacacaaaaaccattctggcttataatggtatgcatttcagaaagataatctcctattgcatattctacgaaagaaggctcgtccaaatgtatattctcgtctgaacttgcaatagaaaaatccagtaacagatttgaaagatctcttaattcattaactttagatgtcagaatatccaaatttttgttaatactctcatttgatttgttttgcaattttaagatatcaatgtatgtcatcaatcccgttaatggtgttcttaaatcgtgagccatatttctcatcaattgatctttttcatcccgtgctttccgttcctgctcatgtgccttaccaatatttactttataatcttttatgatattattaacacatctatagattacataagctccgcttaagattgatattacaatgcctaaaattatgactcctaaataatacttttcagtatatccggcatatatatacattagcctctccgtcagcaaaatttaccggtagttgatatttagcaatttttctactatcatacatgtttttcgctgatacaataaatttatctacattcaatttactatatacagcttctccatctttttctataatgcaaaacaaaacacaatgataatccatccattcatcacattccgatatatctgatgcggctatatttttctgagacacatactgttgaaattcctgaacatatggagattcatggtcataaatatatcttgaattattaaaaaaaagagtaagaccatttatccctatgccatatatccctccaaatatacagcacgataatattattgcaccaaatataatttgaactgcctttactgctttaaaatcacttttcaaatttgtatccctttccccatatagtttctatgacagccctgttgcatatttcatagaatttattccttatattttttatgtgtaccataactgtatttcccgaattatatgtatacagttcttcccaaatatttgaataaatcacctcaagtgtatatattctatcaggatgttttgcaagcaatttgattatttcatactcttttcgtgtaaatttaacacctatgccattcacttctactctattcttattttcgtatatccttatatcttttctgtctatatattcatttcctgcattgtcatcaattatttctctatcatatacatttctacgccttaataatgccttgacacgcgatataagctccatattggaaaacggcttcacaagataatcatcaccgcccacttcaaagccttgcattatatctatttctgatgattttgcagtaagaaataaaattgggacacttgattcttccctcaattttttgcaggcatcaatacctgataacaacggcattattatatccataataaccaggctatatgtttcatcgaatttatttaaaccgtccacaccatttacagcaatatcgacataatatccctgtaattctaataatgtctttattccattacgaattgtttcatcatcctcgactattaatatcttgtacatcttatatcctcaactttgattaaattcagtaaaaaatccatatatacttaaaaagcagttatccctctatcatttaaatattcatatatctgatcatatgtcaccagcgatacatttcccatttttccggcttcctcaatacacccttgggtaaatcctttttttgcgaataaaaataaatggacattctcatatctaaacaatctgcttctctttttcagcttttcgagcacttttacatccacattttcatttatccacttacattctccaaacaatgcagtgcttttatcctgatcacccattatatcaatttctgtctgtattctctcttgtggatctgttccccaccatcgtccaagattgctaaattccacaggtgattccccatcaagcagcaatttccacatatactgcatacatatttcttcaaatatcctgcccatataatctgacagatttggagcaattcttttatacgcaagttctgttgcacctctgctaatgatagaattattatcaggtataaaccgataccagaatctaaacatattatcagctattgcatatattgattttctggactccttttcgccatatggagtttctttccgtattaagccaagattaatcagatttttcatatactgtgagcatacacttgtcgtttcgcctatcttggttgcgatttccgacatacgggagctgcctgttgctactgctgttattattgcattatatacagcaggttcacggacttcctgctttaacagattttcaggttcctcaaatattgccgatgctgggttgaggaacacattttttatattatcctctacactcatgctgtcattcatctgtaaaagatattgtggagtaccaccaacaataccatatatcagagccatatcctctgctgaaaatccgttgaaatatttgcagctatcctcaaaatcaaacggaagtatcttcatctgggcagttcttctgccatacaaaggtgccttatacgccagcacattatcttccatgtaagacatagatgagccacataaaataagcatcattttagaattatctttatttttatcaataagcatctgcaaggttgaagccatgcttttcgaagcttttgccacatatggatactcatctatgacaagcaccagtctttcattttcacataatttaaatacatattctattgcagcctgaaatgacacaaatgaagtccccggcattattcctgaagcatattccatgattgcctgactaaagttctccagattctgcttttcgttgctctctactcccataaaatatattgcttttttatcctgtataaaatggcttatgagagctgtcttccccactcttcgtctgccgtagattactgcgaattcaaatttatccgaattatataatccgtttaaagttgcaagctctttttctcttcctataaacatagctcttctccctccatttctatacacaatattttattacttatatatgatttagtcaatcataatttagttaatcgtagataaccaaatcgtaaatgactaaatattcctctttcatttcgcgtacacaaaaaagacggccgtcccggtccccaccggttcagccgtctttataataaatttcaatgttatacttttatattttactcttatttatacttttttactaacttttatacttgtttggatttagcatctactgctgtgcaagcactgcctgtacctctgcctctgtagcgcatgccattaccttgtctgccaatgccttgcattctgccatgctgctgtctgcgatggtctttctggtcttgagcacacttgtggcactcactgagaactcgtcgagtccgaatgcgagtaacagcggaatgagctttggatctgctgctgcctctccacacatgcctaccatgattccctctttcttaccgcactcgatgatacgcttgattgcgcgaagcactgccggattgaaggctgaataaaggtatgctacctttgagtttccacggtctactgccattgtgtagcctgtcaggtcgtttgttccgatactgaagaaggctgcctcttttgcaagcacatccgccatcatgcaggctgccggtgtctccatcatgataccgatttcgaggttcttgttgtatgcaatgccctctgcatcaagctctttcatgatgtcagctaccattgcctttacactgcgaagctcatctacgcatgtcacaagcggaaccattatctttatcctgccgaatgcactggctctcacaagtgcacgaagctgtgtattgtagatgtctgttctctggaggcagaatctgatagctctgtaacctaggaatgggttgtcctctttctcaagacccagatatgggatttccttgtcacctccgatatcgagtgtacggatgatgacaggcttgcccttcattgtctctgctactgatttgtatgcctcaaactgctcttcctctgtaggaattgtgtctctgtccatgaaaaggaactctgtacggaaaagtcctattccctctccgtcacactctacagctttctttgcgtcctcaggctttccgatattgcatacaagctccacctttgtgccgtctgctgatactgtcggcacacccgcaaatttctttaagagttctttctcttttttgtattcctcaagcagctcagcgaatttctgctctgtctcagcgtcagggtttacgattgcctctccgcttgttccgtcgagtaccactctgtcaccatttttgacagatgtgcagattccatcaatactgagaactgccgggatttccattgctcttgcaagtattgctgagtgggaggttctgccacccacctctgtgagtattcctgcgatattctctgccacgatacctgctgtcatggatggtgtcaggtcatgtgccacaagcactgtacctgccggagctgctgagatatcgtagtcctcgattccaagcagaatcttaaggattctggctttgatatccctgaaatctgttgctctctgctgcaaaagctcatcaggtatctgtgcaaatatctctgctgtctgctcaagcacctggtcgagtgccttctctgccgtgattttctcacttactatgagcgctgtaatctgctcctctattgtcggatcctgaagcatctggatatgtccgcgaaggatatccgcatcctttgctccgactgtcttttccattctgtctgccatggcatttgtatcatctacaaatttctcaatggctccctggagacgtgcgatttcagcgtctgtatctgtaattttcttattctcaatcactatctcatgctcttcgataatgaccacatttccgattccgattccttctgagccggcgattcctttgtacatatcacacctccgattgactttgctggttgattaatctccgaagttgtctgcctcgagctcttccatctttgcaagtgctgcttcctcgtcagctccctcacactcgaatgtaatctctgcatccttcttgatgcatgctgcgatgatgtttacaaggctctttgcgttgattctcttgtcgccgaatacgattgttacgtctgaatcaaacttgcctgcctctcttgcgataactcctgcaggtctcatgtgaagtccctctgctgcttttactaccattgtcttgcttaccatagttttgtcctcctgaatttaaaattattggtttgtttatttcgctcacacatatgattaactgtatcgctctctgctattcatcagcctgtcatatgtccgttgctttctatggttttattgtactgtgcggtatgagttttttcaatattccccaaaatgcaaaattgcaccatctctggtgcaattttgtattaatgtgatattcagttccaccccagctccttccggatagctacacaaagctcatgaggtgaagcagcctccctgagcctgtccgtcgctccattttcattcagaagctttgtgaagtcatggaaaaatgcctttgtcgtgttgacactgtcaaagtttatcgcgagcagaaatatcatgtctgccattctctcgccccactctatcggcttgtcgaggcgtatcacaagtatctggcagcggtttacatgctcaggctttccgtgcggtatggctatattgcagcccacagcggttgcctccaccttctcacgctccagtacatccctcgcaaactcgctctgcactattcctttgtttatgagaagctggcacgcgcgctttaatacatccttgcggtttttcgcctttttctcaaatatgataaattcctccgacagcatctgtgaaaactcgctgacctccgcgctctgtccggtcatgagctcaaagcacttgtttctgatatttttctcatcctgcgcactgattagtggagaaacatacagaaatctcatatccttgtggatatctgcctgtgtgtctatggtcgagagtatgaggtcgcagtcatactcgtcaatatgctctatgcggtctgacgacaaaatgcttactatccttacatccggcaccctgttttctattttacccgctattatactgccggtcgcatagcctgctgcaccgattaacactgcgcgcactgtcataggatttctgtgcagggctccgcccacctgcaaggcaataaaagctatctcatcctcgctcggcatggcgcctgtgtacttttcgtagtatctcgatactgtaaagcataccgtaaagagactggcatacgattgtgtgatatccgaaagaaacggattgtctatctctatgccgaaatgagtcctcgcaatggagcccggtaaaaagctacgcatgctctcacgtagaagctcattttcaatcagattggctgcgagaagatttgacagatacactatcatctcatcctctatgctaagtgcctcctcacaggacatgacaacacggttttgtccctcggcacaggaaaaaagcattgccagatacatgatttcaggctgtgagaggctgatgccgtgatgtctgtccagaaagcctgctgcctcctttgccatgttctcatgctctgtcattacgaatccatttttctgtacctgctgctctgtttcggtgcccgcatccccatcatttgcatcatcacgcattcggtttgacaaatctaactcatccggcttcagctctttctccacatccaccctgaaaagtgcaatggctatatactctgccagcatctgaaatgtgtaatccgtaaagatgatatcaaagcgtctctccacatgatgtatcatgtcaactgccatcgacagatttacgcttctgaaattattggctatcacctcggccgcgcgtcttgaaagcctgtggtcatcggtcttgataacctgcttatcactgattggatacctgcagaaatgcctcatggcttttctgatatcaagctcactgcctgtcgcatatattccgtaacccgccgttctgtgcaccttaatgccaaagagcagaagctctgcgtcaagctcatttatatcatccatgatgacatttttgctgacgtttaactcctccgaaaaaagcgcatacgtgtatgtatcccagccacttagcagaatatacgatatgtagttctgtcgcttcttctgcgatactgctgccgatttccgccctgccacatccagaatctttcctatctgcgcatcgctaaagcacggcttcatgcctttgcccggctttctgtcgagcgtcatagagttttgctcacaaaaatcagccacctccttcagatatgttttcacacttcgctctgacatacctgtggacgcagcaagagcctttgatgtgacaagctcattgttgtgctctgccagcttttcaattatcaatagtcccttttctgaaagcataaatcaaagttctcctgattatacgtaatttaacaattcgaccggttcatctatcagatttgttgcaccatgctccttcaaaaactctacatcacgaaatccccatgtgacagatacgcactccagacctgagtttttcgctgtggcgatatccacatcagaatcccccacatagattgcttcatctgcactcacctgaagctctttaagtgccttctgcaccatatcaggtgccggctttttgcgtataccctcttcctccatctcgccgactgccgatgtcatatactccttgaaataaagctgattgagctcctttaccgccgggtcaagcttgtttgaaacaatagcaagctttatgccgtttaatttaagctcctttaaaagctccatgattccatcataaggtgctgtattgtcattgcaatgagcctcataatattccttgaaatccgaaaatgtcttttcaaactttggattgtctgccccctgtggcactgcgcgctccatcagaagctttacaccgtttcccacaaatctgcgcacctcgtcgagtgtacgctccggcatgccattttgttttaatgcatagtttgttgcattttttaaatcctcaagtgtatagagaagtgttccatcaaggtcgaaaacgaccgcttttttacggttttcctcctcaccctttgctatatgtgtcttttcaaattctgtcttgcttatcatatatgcctcattcctgtcatcatttggcagaaccataatatctccaggtctgcctgatatataactgctgtcatccttattcttaaatagctttaccttgtgctttagcacaaatgctcttgaaaaatcctcctcaacaggtatgcacactctggcatgtgccattccatccactatagtctccgtatccttattcttgaacttcgggacataatctgtctgtttcacagtaaaccgccagtccttgtatatcctgaagcttttgttcagcctgtccagatttaaaatccgtacactgccgtcttctcctattatgactaccgtatcttcactaaccggtgtggagatatcccccttagctgtccgcactcccatgcagcagcccacaggcagtatatcctttgcaatgatacatcccatcggtatcgggcgttttttataatccacttttttgaagccactcgtatcaaaatcttctccgtaaattatctttgtatcgtttaaataatcaaaaatcctctcttccaataatgatttgattgcagaatccgaaggacgtttgtgtgtaccatcgctgctgtactgaaatcttggtgtcaagtctttttctctgcagtagacattatagctgtctatcagcagatccatcggaataaatccaccggccttgtaataatgtcctccgccggagcctatgtccctgcacacttcctgcgccatttcgcttgcgctcacctcttttatgcagcttctaaacgaaagcttcactccattcttaatcactgaaaataccatacatatgtcaatagcatccacctccagcacaaaatcgcttatgatgccgagtacatttgggtcacatgcccctgcctttacgatcgccagacgatattcctctatataatcgcgccccagcaatgctgttgcggctatgtccagctcctcaagtgacatattggcatttcggaatttggccactatagtgttgtcaaaatccgcctcatcgcgcaggtccctatcaagcgaatgtgttatctcggtaaattctccggtgtcggtgtaaagtccataatacagtgctgttgccaggtttcgatttatctctacgccctcctcacgcagcatatcccacacaattgtcgcacatgagcccatatagctcatgacacggttcatagcaggaagctctcccgatactctgtggtgatctatgacagctacattttctgccttgaaaaatgtgacattcccaccaccgtactgacaatcgacagtcacaagcagctgcggattgtctaaaaaatccacatgctctatcggtatgccaagactgtctaccataagcaccagattgctcttgtgtatgatattcctgcctccgtatacaagtctgggactttttccattcatcctcaggtattcatagactccaaagccgcttgccagtgcatctgcgtccggattatcatgacattgcacaattatgttatcaaattgtaataaatcacttagcttcattattagctccctgaatagttatattaattcattttctcatatgtgtatttatggctgcttcaaatcatcacattatttcaggtacggaaacaacagtgaacttctgtccttctcgtcaaacatcgaattgtactgcaggatattgtatgcctttatccattttgcctcgtctcctgttgcgtcatccacatgcataaagcactcattctttttcgaataatagccccttgaatttatggccggaatcttctccatcagctctgcgaggaatcggttgtatgccggcagatctatgttggctctctcaagcgtcagtgtggacaggtagttgaggctcgtcacatcaactgtctgtgcatccgtctcgtaattggtccatatgaaaaacggcaccttgtacagattctcaagctcctgctccgtaagtccggaattgcccttgccatttaaaagcttgataaaatcattgcataatcccggctgatggtctccaaaaaacacaatctctaccggatcatccacacccttaaagtatgtgatgagattttcgagcgccttgtcactctcattcaaaagtgacagatactggttcgcatcggtgtatgacgctccaaccttgtaaacctcctggttgaagttgtcatatctctcaccgtagccaccgtggttttgcatcgtgactcccatgatgtaaagcttctcgtcatcgctctttttctcgtagcggtcaatgatcttatcatagagctcctggtcagtgatatattcccttagtatctttgtctggtcaaaatcatctataaagtaagtctcatcatagcccagatgcggataaaccttgtttctgctccagcctgtcgcatagtacggatgcatcgcaaccgtcgtatagccgatattcttcaggtttgagactatggaggtcgggtcatcatttatatactgctgataaaccaccgagccgtccggcagaaatgccatcgagtttcctgtctcaaattcccactcagagtttggcgtcttcgcaccgtacacggacgaaagagcatagcctttaagcgtattttcactcagagaatccataaacggcgtaacctgcgtgttggtctcaaaatctcccaccaccgacaaatccgcaaacgactcattcatgataacaatgattgtcggatttttcgcatcagactgcgaatatgagctgtccgtttccttgaaattgcccgctatcttgtcaactgctgccttgctgtagccatcaggtgccttcacaaagctgtcccttatgccgagcacaaagttcagcagatagccgtttctgtacgtgccctttttctcccaggtctcggtgttcagtgacatggaattcataatgacatacagcacgcatattattgtgagaagaatcgaaataattctcatatggatagccgactcgaactgcacttctatgcgccttaccagcactatatacaaaacagccgccagaatcacatacaaaaacttgtagtctatgacgaatttgtattttgtcacgacggaaagtcctgttcccgctgacttcaaatccgcatacgtaaactcattaccacggaattcatagacaaagtaatctataaatccaaacgcgagtatagcaattgatgctatggtacatgtcagcctcgtgttgtttgtgataaaaagtataaccagatatatagcgagcgccagaaccatattcaccacgcatgtcatatcggtggttttcacaaagtcctcatccgtcagcagcacatactgcaccgaaaaaacagatagtatcgctccgatgacaagcagtatcgcagcccaaagccacgacagcttcaccggaagctcaagcttcacatttacaagtccaaaatatactgccgcaaacaaaagaatcacccaccagcttgccgatgtaaagtaacctaccagcgcggccgccactgctgcaattccaaagtgtatgttgttttgttttgttatctcaaatttgatgctcatttctgcctcttcatattgcctcttaatattgcttcttaatgttgcttcttaatgcttcctcttaatgttgcctcttaatgctttctcttagtgctgcctcttaatgttgcgacttgattttaaattatatttcctaattagcaaagaagtcctcaatttgactgtatataatgtgcatcagatttgttcttgcctcaacgcttgcccacgctatatgcggtgtgataatcagcttgtttgaatcctttatcgcacggagcggattttcctcactcataggctcctgcgccagcacatcaagacctgccgccgccagttctccatccataagcgcctgtgccagatccgcttcattcactataggacctctgccaagatttaaaaatatcgcagattttttcatcttttcaaacgcagccttgtccatcagaccaagtgtatcatccgtaagcggtgcatgcaccgacacgatatcagacgtggcaagcagagtatcaaaagccaccctctcatagcccggctgtgaatttcttcctgaggtagaataataaaccacatggcagccaaaagcctttgcgatatcagccacgcgtcttccgatatttccaagccccacgatgccccaggtcataccgctaatctggtgaaacacattggaaaaatgcgtaaacgacgtatcacccacatatttctcgctcttcacataatcatcataatatctcagcttctcaagcaggtaaaatagcagtgcaaacgtatgctgcgccacggtctctgtagaataccctgcgacatttctccattcaatacctctttttgccagatattctttatccagattgtttgtgcctgttgcagtcacacatacaagctttaaattttttgcctgtcctatagatttttcatttacctcgaccttatttaaaacaatcacatcagcatcccttgtgcgctccgctgcttcctctgttgtcgaaaaatcatatttgacaacctctccgagcttgtcatattcggaaaggtcgatgtcgtcaccaattgttttggaatctaaaaatactattttcatggtttgtttcctctgtgctatatatttatttgttttaatttctatttttaggggacttcgcacttgcaggctgtgatggtgcgccggcatatggtatattcctcagaaatatatgaagtcagccacaaaaaatgcatccggatagtctgttttatcagtctgctttttatcgtcaccgaaggttaatggaactttgtggcagttcatatatttcttcggaacacaccatatgccagcgataatgcaggtttgcgtgtgcgaagtcatctcaataattatctatatttatcaatgtttatcactatttattgttatttgacaattttaatctttatttgccaatgtttatgattactaaaaatacagcttgctttaaatactaacaaattacctagcataatagcattaacataatagtattagcgcaatttataaatgtaatcatatgttcatttcatacatataaatatatttataccacatttccggaaataaaaccactgtatcagtgtttgattaaacaaagcttaagaaagcccaccatattaatgataaatttcatcaatatgatgggctttaattattctgtttctctcttatgttggcattttatctcacagagaatttgtaatctgtctctgtgtggtatgtatcgccggcctttgtaacaggtgtactgaagttggtctcatttattgagtttggataaaactgtgtctcgaggcagaatgcatcgcggttattgtatttgactccgcccttgccttcctgtcccacgataaagttggcagtataaagctggattccgacacagtcggtgtatacctccatctgtatgccactctcaggagagtatgctgttgcgaccttttctactcccggagcggtcttgtctattgcaaaattgtgatcatatccacttccatagtgaagctgtgtatcatttgcctcaatatctcttccgattggcttagcctctgtaaaatcaaatggtgtaccctcaaccggtgcaatctcacctgtaggaatagccttggaatcctttacaggtgtgtaatgctcagcatttatctgcaatgtgtgagtgtatacgcttcctgatgcatgaccgttcagattgaaatagctgtggtttgtcatattgaaggtagttgtcttatctgcccttgcattgtatataatagcaagtgcattttcttctgttaccttaaatgtcacatcaacgactgcatttcccgggaagccctgctccaaatctgcatcctctatctcaaaggtaatctcatctaccttctgctccttaacagtccaaaagcgcttagaaaaaccatttgagccactgtgaagactgttctcattgtcattagcctcaagcttgtattccactccatcaatattaatctttgcatcagaaatcctgtttgcatatctaccgacagtagcaccaaaatagctgtactccttctcatatgactttacattgtcatatcctaaaatgacatctctctcattgccatccttgtcctttacaaaaatagatacaactgcagcgccatagtctgtcaaaagtactctcaatccaccgccattgctgatttcataaagcgatgcctcaactccttttgatgttgtaccgaaagcttttttactcatgccccatatcctcctttggttacattatgtttgttgcattttttgtaactttatgtttgttacattttgttttagtacattatgctttttacattatgttctgttactctttgcttggtagcatttcgattgcataatcgcgtttttcttattctacgcattcctctgtattttacttcttttgatcgcataagtaaactttttcgtgcaaatatccgataaaatatttataacaaatatttaagtgcaattatacgttcaaaataaaacctaaaataatagtaactgcatagttataattaaaaataataagaggattaacatgagtacacgagtaagttcagcaacaaatctttcagcaacatattttatgagaaatttttattcaaacaaccgcgatgccatgaaatcatccaaacgcaaagaatatagtattacagagctcgcttacgatgattcaaccgccctgcaccgcgcagctaaaaaattaaagaactacaagtattcggacgacgaaaataccgataacatccgcggaacagtcatggctcttgttgacacatacaacaattccattgattccgcctcaaacagcagttcaagctccatgaagcgttacgccaagcaactcaaaaagctggcaagtaaatacagcgacgagcttgaggacattggcatcacaataaacaaggacggtactctgaaagctaatgaggatctcgtcaaaaaagccgacgcagacactcttaattctctgttcggaaatgacaatgacttcacaagcagtctgtatcgtgtctcacgccagatgagcagctcgtcacatgatgattactacacatcactgcggacaggaagcaatataaatctgacggtgtaaatctaatgatgttttttataatgtaattttagcatttcaactgtagaatttcgactttgcaaaagaataatagataataaatatttggctgtctttttcttaaaatataataaaaaaaagacagccatcgttctgctgtcttttaggagaaggtattttactatggggatagtaaaaaatatataatgtattggggggtttttacagttattatagtatcaccttggcctctgaaagtgttaacaaacatgcacaaattttcgattattttttgtgcagttttactaattaaaatacgttgtccggagttcaattcaccatatatcaattgaaaaagaaaaccaccactcttacgagtgatggttttctttttctaatgagacatcggggattcgaaccccggacaacttgattaaaagtcaagtgctctaccacctgagctaatatcccataataaattaaaatgcccagttccggaatcgaaccagagacacacggattttcagtccgttgctctaccaactgagctaactgggcacaatgcttacgcatcgagttgcgggaataggatttgaacctatgacctccgggttatgagcccggcgagcttccagactgctccatcccgcgatagtatttagttactctataaagagtaatgggcagagatggattcgaaccatcgaagcaagttgcagcagatttacagtctgtcccctttggccactcgggaatctgcccataatacaattcaatattaaattgtataaagccgatgatcggactcgaaccgataacctgctgattacaaatcagctgctctgccaattgagccacatcggcataactaataaaagaattagttaaatgggacctacagggctcgaacctgtgaccctctgcttgtaaggcagatgctctcccagctgagctaagatcccacgcgttacttgtaatgagtgttaaaaaattcatctgatttaatcatccatgaataaagactcactataaacgacccagacgggactcgaacccgtgacctccgccgtgacagggcggcgctctaaccaactgagccactaggccatataaaggtttgtaccttcaaaacttcatacaaatccgatttgttttctccgttattaaccagattaagccctcgacctattagtaacagtcagctccacatgttgccatgcttccacctctgccctatctaccttgtagtcttcaaggggtcttactcccgaaggagggatatctcatcttgaggggggcttcacgcttagatgccttcagcgtttatcccttccagacttggctactctgccatgccgttggtcgacaacagatacaccagtggtccgtccatcccggtcctctcgtactaaggacagctcctctcaaatatcctccgcccgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctactttcgtacctgctccacccgtcggtgtcgcagtcaagctcccttctgcctttgcactcttcaaatggtttccaaccattctgagggaacctttgagcgcctccgataccctttcggaggcgaccgccccagtcaaactccccgcctgacattgtcccattgccagttcatggcaactggttagaaacccagtactacaggggtggtatcccaacagcgactccggacagactggcgtccatccttcttcgtctcccacctatcctgtacatgcagtaccgaatcccagtatcaaactggagtaaagctccatggggtctttccgtcctggcgcgggtaaccagcatcttcactggtacttcaatttcaccggatgcattgtcgagacagtgctcaaatcattacgcctttcgtgcgggtcggaacttacccgacaaggaatttcgctaccttaggaccgttatagttacggccgccgtttactggggcttaaattcaaagcttcgcttacgctaacctctcctcttaaccttccagcaccgggcaggcgtcagcccatatacttcacctttcggtttcgcatagacctgtgtttttgctaaacagttgcttgagcctattctctgcggcctgctctcgcaggcaccccttctcccgaagttacggggtcattttgccgaattccttaacaatgcttcttccgccggccttaggattctctcctcatccacctgtgtcggtttacggtacgggcacgcattacacaatagcagcttttctcggcacatggctcacacgctttgctactttatttcgctccacatcacgtcttcggattatacaacggatttgcctatcgtacacctaccccgcttgtaccggtttttccattcccggctcgtgctttccacatgcgtccctacagttctgataatacgtggtacaggaatctaaacctgttatccatcgcttacgtcttgcgacctgtgcttaggccccgacttacccagagcagatcagctttactctggaaaccttagatattcggccgaaaggattcccacctttctctcgctactcattccggcattctctcttcttatccctccactgctccttacggtacagcttcgtcggttttaagaatgctcctctaccactcgcattgcgagtccacggcttcggtgtcgtgtttcagccccggacattttcggcgcaggaactctcgactagtgagctgttacgcactctttgaatgtatggctgcttctgagccaacatcctagttgtcttcgaattcccacatccttttccacttaacacgcactttgggaccttagccggtggtctgggctctttcccttttgactgcccaacttatctcgtgcagtctgactcccgatcatcatctacatggcattcggagtttgatattctttggtaagctttgacgcccccgcggaaattcagtgctctacctccataagactaaatcgaggctagccctaaagctatttcgaggagaaccagctatctccgggttcgattggaatttctcccctatccacacctcatgcccacccttttcaacggatgtggcttcggtcctccattgtcttttacgacaacttcaacctggacatggatagatcacccggtttcgggtctgcgtacactgacttaacgccctgttaagacttggtatcccttcggctccgcaccttaagtgcttaaccttgccagtatccgcaactcgccggaccgttctacaaaaagtacgcggttgttcatttaaagaacttccacagcttgtaaacacagggtttcaggttctctttcactcccctcccggggtccttttcacctttccttcacagtactatgcgctatcggtcactaagtagtatttaggcttacggggtggtccccgctctttccatcaaggtttctcgtgtctcgatgtactctggattccgctcagtcagctctcctttcgcttacggggctttcaccctctccggcaggctttcccaaacctttctgctagaatcactgaatcttaaatgcggtccgaaccccggagtgcacgcactccggtttggcctctttcgctttcgctcgccgctactaacaaaatcgatgtttctttctcttcctccggctacttagatgtttcagttcaccgggttcccctccatacgttatggattggcgtatggatgatacgagttcttcgtaccgggtttccccattcagacatctgcggatcaaggattatttgcatctccccgcagcttttcgcagcttatcacgtctttcttcggctcttagtgccaaggcatccaccctgcgctcttctttgcttaatctcttcgatgcatagcgttgcatcattaataacttaaagaactttgttgttattcacaacttggttttgtttctcggatgtcttgattgttagatattcttaagaatagaatatttattcatcaaatcatttgtatgaagttttcaaggtacaatgtcgattgtaacagttttattacatcgacgatggagacggagagattcgaactcttgaccccctgcttgcaaggcaggtgctctcccaactgagctacgcccccatttaggtaacttatttaattatccaaagccattcggctagtgggcttgagaagactcgaacttccgacctcacgcttatcaggcgtgcgctctaaccggctgagctacaagcccataaatttggcagccacctactttcccataccgttaccagtatagtatcatcggccgtttaagtcttaaccatcgtgttcgggatgagaacgggtgtttcccaaaaacgcatcgccaccaaaaatatgctgttatctattgataactcaacagtgaaaaactctctactcgatttccttagaaaggaggtgatccagccgcaccttccgatacggctaccttgttacgacttcaccccagttatcgagcctgccttcgacagctccttcctttcggttaggtcactggcttcgggcattcccaactcccatggtgtgacgggcggtgtgtacaagacccgggaacgtattcaccgcagcattctgatctgcgattactagcgattccagcttcgtgtagtcgggttgcagactacagtccgaactgagacgttatttttgagatttgctcggcttcacagctttgcttccctttgtttacgccattgtagcacgtgtgtagcccaagtcataaggggcatgatgatttgacgtcatccccgccttcctccaggttatccctggcagtctctctagagtgcccggccaaaccgctggctactaaagataagggttgcgctcgttgcgggacttaacccaacatctcacgacacgagctgacgacaaccatgcaccacctgtcactcctgctccgaagagaaggtacggttaagtaccggtcagaaggatgtcaagacttggtaaggttcttcgcgttgcttcgaattaaaccacatgctccaccgcttgtgcgggtccccgtcaattcctttgagtttcattcttgcgaacgtactccccaggtggaatacttactgcgtttgcgacggcaccgagaagcaatgcttcccaacacctagtattcatcgtttacggcgtggactaccagggtatctaatcctgtttgctccccacgctttcgagcctcagcgtcagttatcgtccagtaagccgccttcgccactggtgttcctcctaatatctacgcatttcaccgctacactaggaattccgcttacccctccgacactctagtacgacagtttccaatgcagtaccggggttgagccccgggctttcacatcagacttgccgcaccgcctgcgctccctttacacccagtaaatccggataacgcttgcaccatacgtattaccgcggctgctggcacgtatttagccggtgcttcttagtcaggtaccgtcattatcttccctgctgatagagctttacataccgaaatacttcttcgctcacgcggcgtcgctgcatcaggctttcgcccattgtgcaatattccccactgctgcctcccgtaggagtttgggccgtgtctcagtcccaatgtggccggtcaccctctcaggtcggctatggatcgtcgccttggtgggccgttacctcaccaactagctaatccaacgcgggtccatcttataccaccggagtttttcacactgcatcatgcgatgctgtgcgcttatgcggtattagcagccgtttccaactgttatccccctgtacaaggcaggttacccacgcgttactcacccgtccgccactcagtcacaaaataatcaatcccgaaggaaatcaaataaagtgcttcgttcgacttgcatgtgttaagcacgccgccagcgttcatcctgagccaggatcaaactctcatgttaaaaagttgatctcagtcaagttaaacttggctaattcgttcattcaggttgcaaataaatttgcaactgtccgtagctcctcaaacaattctgcaagcagattgttttcatcgctttcgcacaaattctgaatttactgttttaaaggtcttcaattttcattgaagcgttctgattgattctcaaaatctttcaaggtttctcactgttcagttatcaatgttctttgtttcactctcttgcgacagcttgattattttatcaaatcgctgttcgtttgtcaagcactttttatttttttgaactctgttttaagttctctgtcttgcgacagcttgtttattctatcaaaatgtttttcatttgtcaagaacttttttcacgacttttttaatcagcttatttcaaagcaatatttataaagtcatgtctgtaaattgtaactcacaagctctacaactcaatgtgtctcgcgagtcagctttgatataatatcatctgtgtcgcataaagtcaacacattttttatctttttatatatatttttttctcattgtttttacacaactatatattgtatttacatacttatccacataccatctattgcttatgtacttttctcttttatgcattattacaccggtttaagctacagtatattttctatcagctttatgacaggattgttttcatacagatacttaagcatcatagaatcatttatatatgctgtcattgtctgtcccatttcagatgcagcaaataatgatgtcagggcaaggagcagccatacgatgaccattcccttaataaaacctactgcaaagcctgcaatccggttcacagtgccaataacaggcaccctttctattttcctgatgatgtgacggactatgtatgccactattcccagcaaaaaaaatactataaaaaatgacaaacctgtcataatggcatttgtaagctgtgcggatatggtgtcgtatgctccggattgctgcagcaatatgtttgccatatcaaaatctcctgtggctttttgcccctgtgcagctatttgtttttcaataccgtttaaaattacgggctctattcctgtctgtgataatatctgatccctgacatatggggctgccatggttgatgcagcaagcattactatccaggctgcaagcgaatataccatgcgaagcacacctcttgtgtagcctctcaccacattccacgcaataatacatattaccgcaattaacagccaattcatttcagtctcacctcgtccattgcgccgtcatagatgaagatatagttattcatacccgatttatacatcaccttgtacagtttgttgtcaaatgtatgatagaatttcttaactccgtgtatggtgtatatctcacatgctgtgtctcctgtgacgcacacctcgttattgctgtcaaactctatactattgtaggcaatagctgtgtcgttttccataagcatcttaccgttaaaatcataaagcttgatatgactggtgcaatttttatcattgttggagtatgctactcctatatatttattattgtaaaatacgctgtctatcagcttttccagcttaatagtctgcttgagctttggcttctggcttccgtcaaataccataatattctgatctgaaactgctatcatcctgctgtcggaaacatatgctatttcaggtatgagctgattctcatacttgtaggtgccgacattgttgtctatctcattttgtcctactgatccaaaattgtaaaaggatataacgctgtccgtctttcctccggagacatctatcatatctacagccagttttttagcatcatatgaaagagctatatcaacaggtatgttcttctgttctccgaaaaactcaccacttgccagctcttttccgtttacatcatacagctttacataataattttcattctcactgacaaggactgccactgtgccctggcttgctatgcaggcttttataataggccacgatgttcctatttctttttttactcccttcttgtccatgatatagaggtctgttccacccctgtcatagatagtcataaagctttcgcatgtaactacctgtggcgatgacatctcaaatgcctggttccatatacggtttccgtctgagtctgtatacaatacaccatcattgctgtactccactaccgctccgcagaaatccacgaacgacaccgcactcttgtccttctgctccacgctgtttttgacgtcaaatgacttgtaggtgcgcagcgccatccacaaccatactataagaaataaagccacgactgctgccacgactattattattctttttgctatttttcttctatgctttcgtattttctcctcgagctcgtccaaatcggtctcgacagttttaaagtctgatttctgtgccataatcttatccttttgtctacttccaaagtgtttgttacttgtcagtataccattcaccggatattttttccactggaattaaatcttcttctgtggacatggcaggaagtgtctcctttttgtctattgtgccgctcattccagcgccggctttaagcccgataagcactataagcactgctatcgctgctatcatcactacagatgcaaacgaacccttgcgcggttcttttcctgcctccatggcttttctgtaccggccgcgttctttcgatatgctgccaaattcctcaggaaacgacacattgatcctgtcgtctgccgaagctcttctatgtatccggctgtagctgcttttggccgctgtgtcagtgtcctcataccggctgctgcttttattattgtcatcgacattactataactgtctattttattattgttgtttgcattactatagctgtaggttttattgcaggtgtcagtttcattatagctgtcagcactatcacaatgctcattcatgcggtaatatacaaaaaagcctgtctttttcttcagatgattattctttttgataaagaagttttcctcctgctcggtcctgttcaaaaggaacataagctgatgagccccgccaaagtgctccctatgtatattttcaagcatgggtgttggctcagccggaaaatcctcctgcctgaatgcccatccgacgataatcagctcctcgtagcttttctttatctccgcaaacactctgctccataccttgttggtccaaagaggcgcatttttgtcaaactccatatcatatactgcaatcgccgcctccacaaatgtggcatacctgcctccgctgctctccgtatgccccataagtacaaaaacctctttatccttaaagccctctgtctttatgcgcttgtacgctttctccgatatgtaaacccggccctcatccgccggtgtaccaatctgcttgacgttgttcgtcacaatatctatcatgccagcctcctttttcggtcagcatagcacttgcaaaatgtaaatttatgcaaaattgtgcgattataaaggtattttgcagttaatccccaacgaaaaaaggacgcatgaacccatgcgcccgacttttcccatatgaagcagtcaattgcttcgcactcgacaccctataatccaccggaaagcgtacagtatattctgaagaaaacaatatgaactgccgcagggttccattatgtaaaatagcaagaatgactaaactcattcaacacgctatccacaagaaatcccgcggctgacttcatattttttctgaagaatatactgtatgctgcaccggtgaacacagcctccaagtgcgaagctcatactccactacttcatataattctttactttgttgtagatgccctctgcatccagtccatacttgtggataagctccactgccggtcctgactcgccgaagcggtcctctacaccgatacgcagaagctttgtaggctgctcctcacagagtacctctgccacagcacttccgagtcctccattgatagagtgctcctctactgtaactgccttgcctgtctttgatacagatttaacaatcagctctctgtcgattggcttgattgtatggatattgataacctcagcatctatgccgtctgctgcgagcatttttgctgcctcaagtgtctctgatacctcaagtcctgttgcaaatatagatacatccttgccttccttaagtacaataccctttccgatttcaaacttgtagtccggtgtgtcgttgattacaggcactgcaagtctgccgaatctaagatatacagggcccacatggtcgtatgctgcctttactgcggctcttgcctccacatcgtctgatgggtttattacaaccatgcccgggatttctctcatgagcgaaaggtcctcgaggcactgatgtgtagctccgtcctcacctacagagattcctgcatgtgtggcacctatcttgacattgagatgaggatatccgattgagtttcttacctggtcatagtttcttcctgctgcaaacatggcaaatgagctgataaaaggcaccttgccgcatgtagcaagtcctgctgcgatacctgtcatattacactctgcgattccgcagtcccagtgacgctcaggaaactccttctggaagatacaggtctttgtggcacctgccaggtcagcatcaagtacaataaggtcatcgtgtgcttttccaagctctacgagtgcgtttccgtagctatctcttgtagcgattttctttacttctgacataatgcttcacctgccttttctaagtctgccattgcaatttcatactcctcgtcatttggagcctttccatgccatcctgcggcattttccatgaaggatacgcccttgccctttacagtctttgcgataatggctgtaggcatgccctttgtctcacgagcttccttgaaggctgccctgatctggtcgaaatcgttgccgtcgatattgattacgtggaaattgaatgcctcaaacttcttgtcgattgggtatggtgagcatacatcctcaacagaaccgtctatctggagattgttgttgtcaacgataactacgagattgtcgagcttgcggtggcctgcccacatggctgcctcccagatctgtccctcctgaatctcgccatctcctgtgagggtgtatacacggtaatccttcttgtcatatttgcctgctgcagccattcctactgcgacagatacaccctgtccgagagagccgcttgacatatcaatgccagggatgtgcttcatatcaggatgtccctgcagatatgagcctgtatgacggagtgtctttaaatcctcctttggaaaatatcctttctctgcgagtgtagagtaaagtcccggtgctacgtgtcccttcgagagcacgaaacggtccctgtcctcccatttaggattggcagggtctacattcatctcctcaaaatacagatatgtaaaaatatctgctgatgaaagtgatccacccggatgtccggatttggcactgtgaactgctgtcacaatgtccttgcgaatttcattcgccatcttctcaagttcaagattgttcatgatgtctccttctatcatttatatctctgttcttccttgaagcgccctaagcagggtcacctcgtcaatatattccaaatcgcctcctacgggaactccgctcgcgattcgtgtcactttgatgccggtaggcttgatgagcttgctgatatacatggctgtagtctcgccctccaggcttgaattggtcgctataatgacctcgtctacatctttttcaaggcggaccatgagctccttaagacggatatccgcagggcctatgccaagcatgggtgaaattgcgccacccagcacatgatacactccctcatatttaccggtcttttcgtatgccacaagatccctcgtattctcaacaaccatgatggtcttgtggtctcttgccgcatccttgcagattgggcatagctcgtcatctgtgagtgtatagcagcatttgcagtatctgacatgctccttcgcatcaattatggcgtcagagagcgattttgcctgctcctttggcatatttatgatatgaaatgccagtctctgcgctgtcttggctccgattcccggaagctgtgacagctcctctattagttttgatatctcactgctgtaaaaatccattaaaacagaccgccacccaggccaccggtaattttggacatagatgcctgtgactgctcatcaatctggcgaagcgcctcattggttgctgccatgatgagatcctcgagcatctcgatatcgtcaggatccactacctcctcagataatttgacctttgtgatttccttttttccagaaacagtgacttcgactgctccgccgcctgcctttgctgtaacctcagcatcctcaagctgcttctgagcctcctccatctgacgctgcatcttctgcgcctgtttcataagattgttcatgtttcccggcattcctccagggaatccacctcttcttgccattctggcgtcctccttgtttttgatgggctaatcccagccctgtttataacttagttttcttcctctatatcaaaatttatcatatctgtcaagtccacaaccgcttcctttgcgctgactgcggaattatttttcttgaccgtcacctcgacttttttgcctatacgcttttctataagcgaagccagcgtatccatacagcctgcacggttttcagagagatactcatatgcattctcatcatcaaacattaaaatcaggtcagaggaattgccaagcgatgtcacagccttgttcagataaacctttgatgttgctcccatctccgaaagtatggatttccagtgcttcatgagctctgagatatcctgtggtattgctttgggaagctcctttttcactataggcccgcttgctgcggcctgctgcatatcctgtgtctgcgcagcctgtgccgctacaggtataccattttcaagctttttctctatgctgtttatgcggtcaagcaccgaatcatagctcttttccatctgcggcctgcacagctttattatggctatctcgaccataatacgcttttgcgatgcaaactttacctggctggacagctcggaaaataccctgatatacctgatgagtgtctcaggctttacaagcgctgcctcttccttaagtgcctcaagattgtcctttgagatgtcgagcacttcctccatatcgtcggagctctgcaaaagcaaaagattcctcatataccatgtgaaatcattgacaagctgcgacagctccctgccatcatctatgagctcgcccagtatgcggattgcacctgtcacatcctcgtcgagtatgcgccttaagagccttgaaaacacctctgtgtccaccgctccaagcacctcgagcacattttcataggtgagtttctcacccagatggaaagcaatgcactggtcaagaagacttaacgcatctctcatggagccgtctcctgccttggccacgtaccttatggcgcgctcctcaacctccacctgctcctgctccatcaaatcgctgagtctggatgcaatcgtatctatggaaatcctgtggaaatcatagcgctggcatctggacaggatagtaatcggtatcttgtgtgcctcggtggtcgccagaataaatataacgtagctcggcggctcctcaagtgtttttaaaagtgcattgaaggctcctgccgaaagcatatgaacctcatcgatgatatagaccttgtacctgccctctgtcgggcggtatgtgacctcctcacgaatctgtctgatattgtccacgccgttgtttgacgctgcatctatctctatgacattcatggatgagccctcagtgattgccctgcacgacggacattcgccacatgggcttccgtctacagggtgctcacagttgactgcctttgcaaatatcttggccacagtggtctttcctgtacctctcgtgccgcaaaataaataggcatgccctattctgtcagcttttatctgatttttcagtgttgttacaatgtgttcctgtccctttacgtcctcgaactcctgtggacggaacttacggtatagggcctgataagacacgccttttcaccttccttatatctaatattgctgcttaatctccgaagcagataccggtgcgctttgcttccttgatcatctggctctttggatctacagtcttaagctttcctgctacgtcggcaagcggaaccctctttgtctgtccgtttaccatggctatcatgcagccgtaatcctcatccatgatggcctttgctgctgctgagccaagacgtgtacaaagcactctgtcgtaaggacatgggctgccgcctcgctgtgtatgtcccggaactgccactctgacctcaagaccgagtctttcgctgatgcggtctgcaacctcgtatgatactgacgggtatttgctctttgcaagcttcttcttgtattcctttttggaaagggctgcatcctccttggagatggctccctctgctactgcaagaatggtaaagcccttgccctcctttgttctcttgtggatggcatctacgaccttgtcaatatcgtatggtatctcaggaagcagaatgatgtctgcaccgcccgcaacacctgcgtacagtgtgagccagcctaccttgtggcccataacctcaacgataaatacacggttgtgggatgctgctgtggtgtggatgcagtcgattgcatctgtagctatattgatcgcgctctggaagccaaaggtcacatctgtgccgtagatatcattgtcgattgtctttggcagatgaatgatattaagtccctcttccctgagaagattggctgtcttttgtgtgccgtttccgcccaggataacgagacagtcaagaccaagcttcttgtatgtgtttttcatggctgcgaccttgtccagtccgttctcatccggcactctcataagcttaaaaggctgtcttgatgagccgagtattgtgccgccctttgtcaggatgcccgaaaaatcctttgatgtgagtattctgtagttctcatatatgagtcccttgtacccgttctcaaagccgtaaatctcaagctcgtcgacattgtgtgccagcgcctttaccacgcctctcatggctgcgttaagtgcctggcagtctcctccgctggtaagcattccaattttcttcattgctgcttcctccttatgcattattatgattgtcttttattatgctaatccctgtactccttatccttctcctcctcgcggagcctatcctcctcattcatgagctttctgaaaatacgctcaaaaataaactcataggtgagtgctgcgccgacaggaagtatgaaaatgagtggaataataatccatgcaagtataagtgataccacaagtatcactatgaccaataatgtccacggcaggttggcgataagaatgagtattgtattcttaagggttatctttgtgacctgctcaaatcgtgaaatatacgctgatgtgtatatggcccaggctgcggcgataagtgccattatgatgaacacgatggagaaggttccccactgattgcctgtcttaagacctgaccacgtaatataaatatctcccaaaagcacgataagtattataagctgtaccagccatgccttggtggcctgcttgaaatttaccttaaacgcatgccagtagcctctccacacatagccctcatcgtgatggatgacacggcgcgatgtatcgtaaagtgctgtggatgccgctcctattgtaaaaacaggtatgcatgatatgatccagcaaaagctcaaaataaccatatctaccagtttgtttaatgctctgaaaaatttgttgtctatgttgaaaatgcccataatgccctcctatatcctgtggtgctctctgttttgttctctctttttctcatagcgttcttcacgctgcctcttcctctcctcaggtgtgaggcgttcctttttcctgccgatatagatattccacttaagatatgcctcctgggcatttcttgacttgtagatgatatttttctcctcgcctactatatccgtgatgctgtaccagcctttatcgtacatgaactctgactgcttatcatcgaagtccttggttcccagcacaaatttgtgtattgcatgctgctgtcccatgtaatcctgtcctccttgttgtaattttattttatagccaccttgtccagtacatagtcaactgcctgcctaaggtgcttatccttctcatactgctcagtttccttaagctttaaagcttcttctccggtgaacatatcacgcagtaccacccggtgatgctctaccggtatatatgacaccttgtcctcaaacacaggcttgagcacatagtatggcaccgccttttctctcttagatgccgcaagcgatactatgttgtcaaccacgcatacgccaagggtttcactatatataatctgtttcttttgaaacatgcttttacctccgtatttacatacacatctataatatcacagacagcgttctttttcaaaaacattttatctggcatttatttttttatctttctggtcatagaaatatggtcagacgcatgtatacttatcctatattttgttaatggcggtacacttgcagtgtggcaatcacctgtgatatacgctttcataatttcttagcctagtgggagtaaatgccgcctcaaacagagtttatcaagcgcaaaaaatttggaggatatatgaagaaagcagccgtttttaacgatttgtccggctttggaaaatgctctctgaccgccgcaattccagtactgtccgcacagggcgtacagtgctgtcccatggcatcagcagtgctgacaaaccagacaggatatgaatatcataaatgcacagacctgacagccatgattaaagactacatcgacaactggcagaaaaataatgctcattttgacggcatttacagcggtttcatgacaggctcaaagcagattgagctttttatggattttttggatgtattttatgaggaaaacacgatgctgctcgtggaccctgtgatgggcgatgacggcagaacctacggcatatactctgccgctcttttggatggcatgaaggcgctttccagaaaggccgatgtcatcacgccaaacctgaccgaggcatgccttttggcagactatgatatcgaaaaggtatacagtgacacgagaaaggatgtgctcctgcctcttgcgacagagataagcgagaagctgcgatgcctgtccggcaaaaatcaggatgtaatcatcaccggtatcaaatgcagggatgataagtcaccctttatctacaatctcgtgaccaccgcaaatggtactacaacccacagatcacactttttcgacgtgagcttttccggcaccggcgatctgtttgcatctgttatatgcggaagcaggctgaacggattttccacagaggaggccgcagagcgcgccggaaaattcctgtatgacagcatcgcagataccatgaatgatgacaccgcaccgaatgacggagtgaatttcgagaagtttttgcgggagctgatgtgatgtttatgtgattcttatcaccctttgcagaaaatttatcgaattgtcagttgacctcttaagttaggcttaacacaaaacaaaggagaacatatttttatgaactcacaggttaaaaaactcacatttactgccctcatggcagccatgattactatttttacagcatatatatgccacattccggttggacagaatggcggatatattcattttggcgatagccttatctatatcgcagcgtgcctccttccatggccgtatgcaatgacagccgcagctatcggcggtggcatggcagatttgctgaccgcacctatctgggcgcctgcaacaatcatcataaaggcactcatatccatcccgtttaccaacaaatcagataaaattgtgaccgtgagaaatgtagtatcgacaatcatagctttcgcaatttccgcaaccggctatgccattgcagaggcctttatcacatatggcttcacaaagcaggccttcaccggtctcatcgcaataattccggtttctgttccgggaagctgtatacaaagcggtggaagtgctataatatttgttattcttggactggtacttgataaaatcggattcaagagaagatttttcacattggaggagactaaataatggctgatataatctatacatataagaacgaagtttatgcaaatatcacaaataaatgcgactgcgcttgtacattctgtatacgctctcagaaggacgctataggcaatgcgacatcattatggcatacggtggacccaacatatgatgagataatagctgcaatcgatgcatttgattttacaggctatgaggaattcgtcttctgcggctacggtgaaccaacctgcgcgctggatatccttgagaaaacagctaaatatgtgaaggaaaagtataagcttcctatccgcgtaaacactaacggactaggcaatctctatcacggaagggatatcgtgccggagctttctgagtatattgattcggtttccataagcttgaatgctgcaaatgccgaggaatacaataaggtcacaagaccaacctttgacaatgcttatgaggctatgctggattttgctgaggaatgcaaccgcatgatcaagcatacacagctttctatcgtggatgtactccccgaggaggatataaagacttgtcagcagattgctgatgagaggggtattcatctgaagatacgtcatttttcgaattaagcgcaaaaaatatttacagctaatatatcagctatatcttgataaaaataccaaaaagggataatatattagcatgattaacttatatcaaaaaacatggacagaaataaataacaacattgcacaaaagatagtacgcttgcgcaaaagaaagaaaattactcaaaagcaattagctgcaagatcaggtgtaagtcttggttcacttaagcgatttgagcagagcggcgagatatccctgcaatctttgaccaaaattgcaatagctcttgatgtggagaacgaacttgaagacttgtttaataatgtgccatttgcatctatcgaggaggtaattaatgaacagactaaataagctggaagttttttatcatgaaagactcgtaggaacgattgctttgtaccaaaatcgtctggctgcgtttgagtatgacagtaactggctagcaaatggattttccataagccctttttcgctgcctttggaaaagaaggtttttatgccaaagatagatccgttcgagggactttttggtgtttttgcggatagtctgcctgatggttggggcagattgttggttgacagacttatgaagaaaaatggcataaatccatatgatataggcagccttgagagacttgcgattgtaggggcttccggaatgggagctttaacctaccagcctgttataacaatggaaaaaaatcacgatgagaaatcgttggatgaaattgcactggaatgtgaaaaaatattgagcacagaaacttgcgataatctggactttctgttttctaagggaggctcttccggcggagccagacctaagatacttacaaaggtagatggagaggattggatcatcaaattcccgtcatcttatgatagcaaagatataggcagacaggaatatgattatgcaatgtgtgccaaagaatgcggaatagcaatggaaaacgtaagattattttcctctgagcgcacgaagggatattttggtaccaaaagatttgaccgtactaatgactctagaagcagaagaattcacatggtatccacttccgggctgttagaaacatctcacagaataccaaatctcgattatgatattctgatgcagcttacactccagcttaccaaatctatggaagaatgtgaaaaattgtatcgacttatgtgctttaatgtgtatgcgcataacagggatgaccattcgaagaattttacttatctgtatgatgaagatgaaggctgttggaaattgtcaccggcgtatgacctcacctacagtaattcaatcggtggagagcatgctaccacggtaaatggaaatggtgtaaatccggaactggacgatattctcgcggttgcccaaaaaattggattaaatatgacaatggcaaggaaaaccgcactgaatataagggattgcgttaatgaaatgcttggtgaatatctatagttcagtgataatatattatctatatcttgaaaatggcaaaatggatactagcccaaaagatagtatgctttcacaaaaagaaaaaaaatggcttgtgaaaaagcgaaaaatttcacaagccatatttttatgctattctatattaatctttgaaaagatcagttgagtaatatctgtctccgctgtcaggaagaagtgctactactgtcttgcccttgaactcaggtctcttggctacctcgattgctgcatagagagctgctcctgaagaaatacctacaagtacgccctcctcttttgcgataatcttgccgtactcaaatgatgcctcatttgatacagggataatctcatcatatacctctgtatttaatgtgtttggtacgaagcctgctccgattccctgaatcttgtgtgctccggcttttcctgttgaaagcactgctgatgtctcaggctccactgcgataatctttacatcagggttcttactctttaagtactcacctgttcctgtgattgttccgcctgttccaactccggctacgaatgcatctacctgtccgtctgtatcgttccagatctcaggacctgttgtctttctgtgtgcctccgggtttgcagggttctcaaactgctccggaatgaagctgtcaggaatctgctcatgaagctcctctgccttggcgatagctcccttcataccctttgtaccgtctgaaagcacgagctctgctccatatgccttgatgatgtttcttctctcgatggacattgtctcaggaagaacgatgataatcttatatccctttgctgctgcgattgcagcaagtccgattcctgtatttcctgatgttggctcgataattgttgagcccggcttgagctttccgtctctctctgcctgctcaatcatctcttttgcgattctgtcctttactgatcctgccgggttgaagtactcaagctttgcaagaagtcttgcctcaagtccgtatgccttctctacgtgtgtaagctctacgagcggtgtatttccaataagtcctaatgttccctgataaatgtttgacatgtttgtgtcctccttgatgccattgtaatgttaatgctttgttttaatctcctatattcatactgtatttgtatgaattaattgttgatataaatataccccatgaatccctatctgtcaacaggaatttatggggtttttaattttttatctcaggcaaacagatcatccatcgtaacaaccgactgcagctcctgcgaatacgagttttccaccacaccataggttgtaataagtgttgggtatatcgcatactttgtaccggaaaccactctcagatcacttattttattcctaatgctcctgtccactttctccgttatggtatactctgactgcgaatatttcatctcgcacaaattaatcacctgatcttttctggcaatcagcatatcaatctgtgagccgaaaatgccattatccggatctgatttgcagtaccacgaatttacctctgtcagcactcccgaaatacccagtttaaacttaatctgatctacatgctccatacacactctttcaaatgccagccccagccacgtattcactgcgggcgtattaatctggttcgtccaaaaatgctcatctgtcggttctgatttcaaaaatttgaaataaaacaatgtaaagtaatccatcaactggtatatcgcatttttctttttcatcccaaatgcattgtacttgcgaataaatccacagctttcaagctcttcgagcttcgttgtcagatctcccgaattaggtattttggtcgctgtaatgatttcttcccttgtcattccaacctttttagtcccaagagcttctattatttttacataattctccggttttttgaatacagaagcatataaatacttaaattcatcgcgcagaggcgcatccttttcaaacaatatactatcaatattctgcgaaaggcttaatccctttttcaaaaatccccaatagtaaggtactccgccaaaaatcatataatactgcaatatctgatttctatttaatgccagcccggcagcttttacatacgcttcacactccctgaggcagaaggtgcgcagatgtatctgctctgtcaatctgttatacaatccgcctttgttgtgtacgacctttgagagcatccatgatgtggctgacgcgcacactataaggactatatctttccttgcagaagcaaatccattccagaaattctccaaagcaaccataagatcactcttttgtgtgtccatccacgacagctcatcaataaatattattttcttcttttcactcgacaatcttatgacatcctttaatgcttcaaatgcctcaagccagttttggggctgctttttcacttcataccctgcatcttttagagatgacgtaaacgcatatatctgctccttcattcctccctctgacagaccggcatgctgaaatgcaaatctatagccaaaagcctcacgtatcagaaaggtctttcccactctccttcgcccgtatactgccacaaaatgtgagctatcatcattttgtatatcatgcaataaatgtaattctttttctctacctacaagcatcctgcacctccaaccaaaatatattatattgctatactcttcttaatctctgttttttatacactttaagtaaagtataacggtattttggacaaaaaacaagtcaaaacgcaaatatactcttcttaatcttataaaaaatagtagattaagaagagtatacgttgtttaattttaatatttatttgtaataacacattaaattcgtgattccaaatggtctaagatcatattggtaaatctccccattaaattcaccagattttcttcccgagtctgacagacatatgacatattttcccatccttcaaatatatgatacgattaactctatccacgctttctatactaaaatcaataacttaatagagcagacggcattttagttatgctgtctgctctattattataatatattcgcgactattcaaaagtcctgctaatttaccatcatcttttcaattgttccaccgcacagtacgtgcccatcctgataaaataccgctgcctgccccggtgtcatggcgcgctgtggctcgtcaaatacgcattttatcattccgttttccataggggtaagtgtacagtcagctcccctgtgagagtagcgtacctttcctatgctgcgggtgcccggtgtgatgtgctcctgtgccatatagtttatatcgctgatataacaggtgtctgagaaaagtgactcatttgtgctgattacgacctcatttgttgcctgacgcagctccttcacgaataaaggtgttgcggctgtaattccaagccccttgcgctgtccgatagtatagtggatgaggcccttatgacggccgagaatattgcccgattcatccacgaaatttcccggctcataggttttgcctgtctcattttcgatgaatgaggcatagtcgtgatccggcacgaagcatatgtcctggctgtcgctcttgtgcgctaccggcagacctgcttcctctgcgatacggcggatttgtggcttttcatactctcccacaggcatcagcgtgcggcgaagctgctcctgtgtcagattgtaaagcgcatatgtctggtccttttccgctgtgactgagttggctatggtgtatctgccgtttggaagctgtgctatgcgggcataatggcctgttgctatatagtctgctcctatctcgagcgagcggtgaagcagcgactcccatttcacataacggttgcaggcgatacacggatttggcgtgtatgcacgctcatattcggacacgaaatagtctatgacgtatttcttgaaatcagccttgaagttcatcacataatacggaatatcaagcactgccgccactcgtctggcgtcctccactgcggataacccacagcagccgccctcctgtgactgtttaaatacatcctcgtcctgccatatctgcattgtgactccgatgacatcgtatccctgttcctttaataaatatgccgctactgacgaatccactccgcccgacattcctactacaaccttctttttcattaatagtcttcctcaggcgcctcttccttctcgctgatatcgtttacaggtttctcgagtccctcgatcttgataccgtttttctctgcgtaatcccagagcgctgcatggattgcctcctctgcgagaagtgagcagtgtacctttacaggtggaagtccgtcaagtgcctccataactgccttgtttgtaacctcaagcgcctcctggattgtcttgccctttacgagctctgttgccatactgcttgttgcaactgctgcgccacatccgaaggtcttgaatttggcctcctgaataatgccgttgtcatctatatccagatacattctcatgatgtctccgcactttgcgtttcctactgtgccgacaccacttggattctccatctctcctacgtttcttggatggttaaaatggtccattaccttttcactgtatgccatgtccttagttcctcctaattttcatgtatatattaatgttgtgatagtcactataatttctaacctgatcatttatgcctcagatttaccgtttttctttacaaaatcctcgtataacggtgacatgcttctgagccttgctatgatttcctttaacttgtccactgtatagtcgatatcctcaagagtggtcttctctgataatgtaagacgcagtgagccgtgtgctatctcatgtggcagtcctattgcaaggagcacatgtgatgggtcaagtgagcctgatgtgcaggctgaacctgagctgccgcatatgcctgcctgatcaagcaggataagcattgactctccctcgatgaatctgaagcagaagtttgcattgtttggcagtctgtctgttctgtgtccatttaagcgtgtatatggaatctcacttgtcactctctcgatgaggtggtctctgagctttgtctcatatgcgctgcgctctgccatgttggcctttgcaagctctactgccttgccgagtcctacgatacccggcacattgtgtgttcccgcacgtctctggcgctcctgtgctccgccgtggataaatgagcggatttttacaccctttctgatatacatcacgccgatgccctttggtccgttgattttgtgaccgctggcgctgagcatgtcgatatgcatatcatctacattaatcggaatatgtccgaatgcctgaactgcatctgtgtggaacaaaatgccatgctcctttgctatctctccgatttccttaagcggctggatagttccaatctcgttgtttgccgccataactgagataaggattgtgtcaggtctgatggctgccttcagctcatcaagcttaatttttccatcctcatcaacacccacatatgtcacctcaaagccatgcttctcaagccactgtgctgtgtgaagaattgcatgatgctcgatggctgatgtgatgatgtgctttccttttgcggcatatgcctctgctgtggcctttaatgcccagttgtcggactcgctgccgccgcctgtgaaatatatctcatccttcttggctccgataaggtctgcgacctctcctctggcatgatccactgctctctctgcctcatctgcaaagctgtatatagctgatggattgccgtaatgctctgtaaagtaaggaagcattgcatccacaacctccggatatacctgtgtggttgccgcattatccaaataaattaatctgctcatctatgataaccttctttctttatatgacataatttccattcttctcgttctgccagtctaccagatcctgcaatgtgatattgtcaaccacacctgagattgcatcattgatcttcttgtacacaatagatgtgacgcactgctgctgtctgtcgcagactatctcgtcatcctctatacatgctaccggcgcaaggctgccctctgtctgtctgagaatcatgccgactgtgtagttctgcggttccatcttcagcatgtatccgccctgggcgcctctgacacttctgacgtagcccgccttgtttaaaatggatataatctgttcaagatatttatctgaaatatcctgtctcttcgctacatccttcaggctgatgggtgaaccagtgttgttctctgcaagatccatcatgaggcgaagagcataacgtccttttgttgaaattttcatttatagcacctctgtttcatttcctactgttttactatacattcagaaatcgcctttgtcaagccgaaaaacagaaatcatttcatttgtcaggcttaattcctctagggatgtaggtatttcttctcttgacacccattttgccatcgaaagttcctgcatgtcaacctcaatctcatctgttccgtcaacttcacagaaatatcccgctagtatattgtcggtaaagccccacggctgcgatttgtagtatctgatgtttttcacacgcagtcctgtttcctccataacctcacggcgcacggtctcctcaagcgactcacctatctcgttaaagcctgccacaagtgcgtactttttatactctctgccattgtattttgtcaaaagcagcttatctccattggtaactcccactatcacagccggattgatgcgcgggtaaaccatgttgccacagaccggacatctgagcatgcgctccacatcgtcctctaccagcctgtttgcgcatctgccgcagaaatggttcttatcataccagccatccagatgaaatccagttatcgcggcaagcacgtactccttcggtgacgcgctgcgcatatagtgccggtttatgaatttgccacctgttacttccagtatatgcattttgtcagcatgtgacagtgccaccctgaaaaatgcagtatcgtcaagtgtaaacagatactgatatttagcgtcggggcattctgcttttatatcctcatatcttggaaagcttatctgatgaatatcctgattggattcgtcagcaggcttgtccgatgcctgctgcacaagaagctgtcccctgctaaaaaaaaggaccctgctgtccgggtccggctgtatgtttttgtatgttatgtcccacgtatgtggtgcaatgtcctgaatcattgtatgcctcgattttcctttttccgctgattatctgtgttatcatacgatgtttattcgtgcgtataaaccgtgccactacaaccgaaaattcgcctcttttttatacgctaaaaatccgagcgcctcgcttcgaaccatcacaacagacgttacctccacagttaactccctccaggctgcctcgcgtcacatgaaagcttctacttagtgctgctgtgttcccaccctgacacggttcatagatttccattgcgcaagacccagacgtcaacgccacttatggagggcagctccaccgcttaagccctctacgaagcatcaccccaactatagcggattgttggttcaaggtaccgctaccaccccggctgctcggagtcttaagtatacgctataatgcagggttttgtcaagatttattgcaacttcttgtgggatgagtacggcacgcaagccccgggtactactgactcacacgtactctctcgccatcgctacgctacgtggctaagatactgtacgaaattatgctttagttttttctatacttgacgaaaccgtcgaaacgcgccgtccatggcgcgattctcctcgcccctgcgtccatgccggggcgtttctgtgtctcatgggcataatttctacagtatctaaacctcttcgctattcgcgcttcgggagagtatgtgtgagtcagtagtacctggggcttacgtgccttacgttgtggttttaaccacaatttatttactccccttgaagctttcgcttctttcgcagctccttgaagaaggtagagagcatagtgctgcattcgtcaccgcagatgcctatatctgtctgcacctgatggttgaactgctgcatctgcagtagattgatgattgagcctgcacagcctgctttcggattcatggcacctattaccactctgggaatgcgtgcctgtactattgccccggcacacatctgacagggctcaagggtgacgtacatggtgcattcctcgagacgccaatctccggtctttttgctggctttgcggatggcagagagctcagcgtgagcgagtggatttttgtcggtatttctgcggttgtagccgcgtgcaatgattttgtcaccggctacaattacgcagcctatcggcacttcatcgagtgcgtatgctttttttgcctgttttattgcctgtttcatatatttttcatcttgtgtcatatttgtctgctccatgtgttataatctatttatcatgatacaccaaatgtgaaagaaggaaaatatgttttttcaatatgagaccccacgcctgcttcttaaggtattacgcgctgattgtgccccgcaggttttggatttttacaatagggataaagagcttttcgaaatgtatgaaatagaccgtgtgccggacttttatactgtgaagcacctgcagaaggtgctcagatatgaatacaatatggctgtcaaatcacagcttttcagattttatgtttttaagaaggaaaatccgtgccggattatcggcactgtgtgtatacataatatcgctccggctttctacggaagctgtgaaattggctataaattttccagtgagtttcaccacatggggtatgccactgaggcagtcggcttctgcaccaagcttgcctttaatgagcttcgcatgcacaaggtgacagcggttgtccacccgggaaatgtgccttcgatgaagcttcttaatgggcttggcttcgtgcaggaggggctattgcatgattatcttatactacatgggaagtggtgtaatcactatatttacgggcttgttaataaatgagcccatttataatttaacataacaattggcgcagtaaacaattcctgcgccaatttatcatactttttaaaaatctatactattttttatatttctcaaaattatatttttattcttctcatgcaaatatgtaggattaagctttcctttttgatatttcaggtatgttcctgccgttttatccacaagcagctttgtaaaaaatcgctcccaactgaaatattcctgactttctatataattctcaggtttgtccataatatccttaatctctttgtcttcaagcaactcagaactgagtataatccactcaaatgattccggcagatataactttatattgcctttttccacagacattttatataatgcatccatttccgggccaattgctgcaccgtcagctattacacaaatactctctgtttcagcttttagttgttctagcatagcaaatatttttgtttttccaccagcgctttcacacactatatttttttctttcgatattgccttgaaatactcatatccagaatttgtatcttcaacaattattttgtcaggtttacatgaaagttcctgatttaaaggataaatatgatacatctcctgatatatttgctttgtgttctgatactttcctgaagaatacagtccatatatttcttcaacactatatggcagattgtacagattttctcttgttattatcacaaaataattatctgacgcctttacaagttcagcaaactcttgctgtcttataaactgattttcttcatcaataaaaatgatatttcctgataaatttttgagcagcatctgccacaggtttccctcaagaactgtgcacggggcatcacattcgatttcaattccgcttgcattaccaaggtttgcaaattgtctgatcatatttatgagtgttgttttccctgtagcactgtccccttttattatcgtgatatttctttttatttcaaattcataatgaagtctattgtttttcacaacaattttatgcttacccttcatactttctcctatacatatttacctgcaacactgatgaattcagccatactgtgaactatttctcccgtattcagtatctttgcctcaaaatctttaccaaaatccattatatgatgcagattaattgtcagattctttttgcccgcaattctcaatatccactttgcgcagttatcaccacacgctgaagcgttaaaaatttttccgctatcatcaaaagccatcagcataagggttttcactccaccggacaattcctttgtggatatcggtcccagtatcgggctttgtaccagatgtggtccaatgacgtctgatttatctatatcttttatcattttgacagacagctcatccgttatccattcatcttcatatgtgttatcaaaatacaccggaggatggtaaattgcattttccatatcccctaaatatatatttaacattgaaatcctccatcccatctgttaggattctaaagtatacgctatgatacgatttattgtcaagtttctaaacatttacactgctctcaccacagcagtgatcagttctgtaaactgctttgccacgcggtctgcggtttcctgcacttccttgtggttgagctttttttcggatagtcctgctgccaggttggtgatacatgagattccgcaaacctcaagtcccatatgacgcgctgcaagtgcctcacaggctgtgctcattccgacggcatctcctccgaggattttacacatcctgacctcggccggggtctcatactgcgggcctgtgagctgtacgtagactccttctctcagctttatgcccagcttatctgccttttcttttacgattttcctcattctgcggctgtatacctcgctcatatccggaaaacgctcgcccagctcatcaatattggctccgatcagtggacttggtatggctgtcgcgatatggtccgaaatcagcataaagtctcccggattaaaatcagtattaagaccacctgccgcatttgtgagtatcagcttttttgcgcccatcattcccatgaggcgtgtcggcagcacaacgtctgttatcggatacccctcataataatgtactcttccctgcatgatgacaacaggcacactatccacatatccaaatacaaacctgcccttgtgtccgggaactgtggatgttggaaagcccttgatatccttgtaatctatggttgtctctatcttaatctgctctgcatagtctccaagtcccgagcccaaaactatggctgtctccggtacaaaatctgttttttcacgcacacttgcaaggcatgtggtgagtttttcatatatactgttcatttttttctccatatattttctgttaaagtttaaaaattcctgagatattacccattaaagctcttcaagaatagaatgtccgatggtaccctccggcatttttatgccgaagttgtcagcaattgtggctccaatcaccgcaaaagtggcttcctcctcaattgcgccgccgcccttcatgctctttgaatacgcgataaaaggcacatattcgcgtgtgtggtccgttcccttgtaggtagggtcgtttccgtggtctgcggtcagtatgagcagatcatcatcccttagcttttccattaaaatgccaagatttttgtcgaatttctcaatttcctctccgtatcctgtcacatttctgcggtgtccccacagtgcatcgaaatcgaccagattcacaaagcacagccctttaaaatccttctcacaaatatcaattgtctgctccattccatgaaccgagctctttgagcggaatgcctctgttatgccctctccacagaaaatatcattgattttgccgactgaaatgacatccagtccactgtcctttaatgcatttaatgcagtaagacctgtaggcttaagcgcatagtcatgcctgtttgaggttcgcatgaactcaccctttttctttcccacatatggtcttgcaatgacgcgccctactctccactcgtccttgagcgttatttttctggctatctcacagcagcggtagagattctgtaaatcaaaggtctcctcattaccgcaaatctgaagcaccgaatccgctgacgtgtatacaatcatcgaaccgttctttatctcttcttctccgagctcctcgattatctcagtgccgctggcgctcttgttgcctatgaccttttttccgcactgcttctcaagctcagcgatgagctccggtggaaatccgtgctctgtgaaggtcttaaacggcttttcggtttttatgcccatcatctcccagtggcctgtcatcgtgtccttgccgttgctcgcctctgccagccgcgtaaatctgccgattggctcagcagccggctgcatctgaccgccacaatgcaggttgagcattccaagccttgtaagatttgggatgtcgagagtctgcatcctctcaagtatatgtccaaaggtgtctacatctatgtctccaaacctttccgagtccggcattgcgccgattcccagagaatccaggactatcacaaaaattctgttgtatttcttcatggtgtcatacctccattttccggtccgtaaatttgtgctgcggttaaatattaaatctccataagcctcacggcactataccagctgtctgaaaatccgctccttcacggcatcatccgcaaatgccacatccagtgcatttttcatcataagcggcagctcttcatcgcgtatgccataggttctttctatgaattcaagctcctttgacagagttgtattgcttacggtgcggttgtctgtgtttattgtgacctttaatcccgcatccaaaaactccctgatgggatattcgtctgctgaagccaccgcctttgtctgcaggttacttatcggacaaagctcgatgcctataccctttgccgaaagctgcctttccagatcaccgtggcctctcatggctattccatggcctatcctggccgcgccggcctccactgcatctatgatattctgtgcatttccacactctcccgcatggattgtaaaaggcagcccaagctgctttgcatatttgaaaagccccatgaagccggacataggataaggcacctcagcacctgcaaggtctgccgcgcacacacccgcgcctaaaaattcccttgcggtgtgcagcatgcgtctgttttgttcctcgccgtgatgcctcatggcgcacacaataagcccatattctatgccaaaatcctttttacctctctcaagtcccttaatcgtcgcctctatcacgcgctcgcagctcatgctctcattctctgaaagcagcggtgcaaaacggatttccgcgtatacgacgttttcccggtgcatgcccttaagcacatcataggcggctccctcaagccccttttcatcctggatgcactgccccggcaagtcaaatttctccagatactgtgcgagacttgtgcagtcatccgacacgctaagctctgcctcctgcaccgtcctgccaagccttttctcgacaaattcacggcttaatgagccatccagatggcagtgaagctctattttcggcagctttattatattgtctcttatattctcttctctctccatatttcccccatttccggtttcccacttcctgttgaggcggctaatgttcacacgaccatataatcaacaactattacagcccattatacagcctattaaaggtacagctacaggtcgctctactcaaggttcgaaggtccgaacccctgcggaagcatatcctcaagtgtgtaaatcctatagttttccctgtcaattgccagtattattttaaaggtcttcggattgcaaaactccatcataacctggcggcatactccgcatggcgctgtataacctgtcggtttttggttctttccgcccacgatacagattgcctcaaaatcccgcacgccttcactcactgccttgaaaaatgctgtcctttccgcacagtttgtcggtgtgtaggctgcattttctatattgcagccggtgtagactgcctgattttttgctaaaagagctgcacctacattgaagcctgagtacggcgcatatgaaaaatcaagctgtacaagggctgtatcaatcagtttttcaattgtttttttatccatatataattccccggttatttattgtatacgaaaattcagtccatagccttaatgagcttcaccacacggcttgtcccaagcctgtcagcgccaagctcaagaaatctttctgcatcatctaatgaagaaatgcctccggcagccttcatcttcacaccctctccgatatgctctgaaaacagctttatatcgtcaaaggtcgcacctgccgtgccaaagcctgtagatgtcttgatgtaatcagcccctgcgctcgtcacgatatcgcacatcctgattttctcctcatctgtgagaaagcaggtctcgatgatgactttaagcaccttatccttgcatatggacttgagcttctttatttcatcctctatcagctcataccttttatccttgagccagccgatattgatgaccatatctatctccttcgctccgtttgcaagggcatcctctgtctcaaaggctttcaccgcagtggtcgaatatccgttagggaagcctatcactgtacagacctttaccctttcacccagatactttgacgcctgctttacatagcttggcggtatgcagaccgatgctgtgtgatattttatcgcatcatcgcatatctgcctgatttcgtcccatgtagcctgtggggataaaagtgtatggtcaacgtgttttaaaatttcatttatatccaatgtctgttctccgtttctgtgttttatgtctgacttattccccggcgcaatcctcacgaatgaggtttcgcactgctgaaactgccacctgaaccgccatgtccgtatcgcgtaccacaggattctcaagcccgagcttttccctctcctgatttgcgaccacaaggaagcatgagcctgccctgactccaagctttgccgcaacgacaaaaagcgcggctgactccatctctgacgcaagacagccaagcatcctccatgcattccatttattgataagctcgtagcctgccggcattttttcaggctcatgctgtccgtaaaatgcatccttgcactgcaccacgcccgtgtgatgcgtaaaatttttctgctttgctgccgcaacaagcgcgtttgtgacatctaaatctgccacagccggaaactctatcggcgcatactcctttgatgtgccctccatgcggatggcgcctgtcgcaatcacgatgtcaccgcttttcacatctgtctgcatgcctccgcaggttccgatcctcacgaaggtatctgcaccgcatctgtacagctcctccatcgcgatagatgcggatggtccgccaatgcctgtcgatgttacgctgaccttcactccatccaatgtgccggtgtatgtgataaactccctgttgtcagctatcaagaccggattgtcaaggtactgcgctattttaacacacctcttcgggtctcccggcatgataacatacctgccgacctctccctttgcgacctggatatgatactgtctgtcaggatcctttgaataatttttcatgtaatgccacctcccacagttttcttttgttagctttaattatacacaatttctgtggttttgtgcagaggaaaggacattttcttacaatctataaaaactacagctggcagaaccagtatccgaacactccgctatcgacatccgctgcatttgccggggcggccggctcaaattccgtgaagccgaatatccctgccatcatgcgctcctgcggctcgctcacgccaggcactccgagatattgtctgccatccgtgtccgtttttatgacgaggtgcttatagtttgcgtaaccgtgtgtaagaaagctgttgttgactatgtaccagtttttggccggaagcgtgcgaagctctgatatgtctatgcgcctgattttgtcctgactgtcatcaacattttgactatgaacctctttctgacagcccggttcaggcttaggagtcgatacaggggtttccttatttgataaatctgcttgtaccttgattggttttcctataactgcttccgtgttatccgtccagcagcttgccagaaatttttcatctgcattttccagttctatttttacaccgagcacctgcaaaaatgtctttccactgtcctttacgttttcggtatctacattatatatctctcgcgcttcaccgttttttaccgtaagctctcctgcctctatgcccgcctccgcttcatataccagatacactcttccttttccggagtattttccgagattttttatctgcacgagaaatgcacttttttctccgtttatttctacttttataaagcctgcattatttccttttattctgccatcatataaatacaggtatgtaacgaatctcttcatgcttatttacccgcctgcgcgttttgtactattctatgagtgaagcagtaagattatgcgtgttattaatttatacttgatttatagctattcgagccatcttgtaaaaataaaataggaattattcttatttttctcttgacaattatagtactatcgtgtatattgatatcagtaacaattcctgatttcatttaaaaggagattcatatgattaagtatagtcgtcaaagagagtcgatagtcaactttctggcgagccggaccgatcatccgactgctgaaactatctatcagaatatcaaaaaagaatttccaaacatcagtcttggaactgtttacagaaacctttccttgcttgaggaaattggtgagatcatcaagatttcgaccggagtcggtcctgaccattacgattacaacacagcgcctcattatcactttatatgcagaggctgcggacgcgtgatggatatcgatttggacttcgccgatgagctgatgacacaggtgcaggaatccactgatttagccattgagagctgctcagtttcgtttacgggactttgtccggattgcaagaatgagctttcctagagcctgacaatttttacaacaattaaacatttatttactatctttaaaaggaggaacattattatggcaaaatgggtttgtacagtttgtggatacgtttatgagggagagaatccaccggcagagtgtccggtatgccacgttggcgcagataaattcaagaaggttgagggagatttaacacttgctgcagagcatgagtttggagtatacgcttcaactgttaagaacaatcctgaaatctctgatgaagataagaaatacatcttcgagcagttaaaggctaacttcgagggcgagtgctctgaggtaggtatgtatctttgcatggctcgtgtagctcatcgcgagggatatcctgagatcggtctctactgggagaaggcagcttacgaagaggctgagcatgcagctaagtttgcagagatgctcggtgaggaccttgagcctaacatgaaggctactacaaaggacaacctcgcttggagagttgactgtgagttcggtgctacagcaggaaagactgaccttgctaaatgtgctaagaagaacaaccttgatgcaatccatgatacagttcatgagatggctcgtgacgaggctagacacggaagagcccttaagggacttcttgacagatattttggttaattacaaaatagataaatattatttgaaaatgcaactcaaaaaccagttcgtaaaaatgtcattttacgaactggttttattttggtcatgttctgcaaatttgaagttatcagtctgtttcatcttttttataacttttattggatctcccagccgtgatagtgggtgccatcgtagctgaaagtaaatctgtaatttgtcaaatgtatatccttcaaaaacgctttggaatctcaattcacagcagcaatgttgaatcagtcctgctcctattccatggatgactgcatttcccacttcctcaagcacagtgagttttggtggctcattcagttccctgtagtgctgcctttttgctctttttgcctctttcttctcttcttttctctttgtccagctcagctttctgctgagtgctcatatctgattccgagttctttatttctgccatatttaatcctgaaacttctttcttaaagataccgcactttatattacaccctcgctgttgattttgaaccgatcaaataacactcacaaaagtcccgcctcactcgtaaaaagtaatgcaggacttttcctataacatttatcttggccatctcttctctaccggtagtagttctttaaacttctgatgaggttcactctgataccagtatgccacacttgaaagatcgtcttgtcgctcaaacaatccattatgactaacccctatttgctgtaccgttactttcagattttcctcaaaaaatacaggatcagggatatgccatctgtaaaatccacgcattggcggacaatcatcattatgatattgattccaaacaagtgaatcatgtctggaataaaatggatatcccaaatatggggtagaataattctgttctacaattctgccattttcatttgatgcgaaactccaggaacctccgaaatagtcttccattcctgttccacatattgttggatatttttcatctccatcaatgtagaatttaacttcaccctctccccaccagtacctctgcaaagctgaaagtcccagataagtacctacataatggccacttccttttacattatcaagaataacataatcttttccaatttcagtgattgcctgccttctccactgagcatgaaaataagaagtgtcttctggaagcgaatcatacaggcagtaatcaatctgataaaaaaaggccggtattggatttttatgctgattctcaatagtaatgcgagcatgtttatgaaatggcattgcaaaataagaattaagtcctcgtgatggaacaacagttataatagcagaattcacaatacattcctgtccaaatccacaacagaagaaatcacccaatggcacttctaccgacggattctcttctccatcccagtacattcgcataatcagatccctcagtacaaaacagtcaccttccgaggtcttactgtcaacagttatccatatatgttggatcacacctggtccctcaatatctgccaaaaattcttcctgtcccggttgaatattattcaaacacgggctccccttacgtgaaggtccaagcgggctggctgccatcccgccttttcctttttctcctgtcctgttctcagcattaattgctctgcttttcccatgtgtcagatagggcatctttgagatatctcccggaaatatcatttcatatcctcctaatatcattctatttatcaacctttagttgctcccattgtcatacctgcagtaacccatttattaagtgcaaaataaataataagtggtggaagtatagatataacgatagctgcaaatgttaaaccccagtctacattaccaaatgctcccacataatccttcaatcccattgcaactgtttttgcattactgtcactgataaatgtatttgcaaaaataaaatcattccatataagaatactatacatggatgcaattgtaattattgtatttcgtgccaatggaaacacaatttttataaatgtaacacctggattacatccatctacaatagccgcctcaaccagctcatccggaacaaaatcatagaaacttacaaacatcatcacagccagaggaagagcaaatccaacctgtggtaaaatcagtgaaaaacttgtattcaagattcccattttactatagaaaataaacagtggaatcaatgtaatctgtactggcaccatgattccgaacgtaaaaaatttataaatttgtttttttccacgtattctgaattttgacaatgcatagcctactgtcgaactgagaaaaataatcagaatcagtgagattcccgttacttttaaactattccacatataaatgcctatttttccatctgaaaatacctttataaagttttcaaatgtcaccactttcggcaaagcaaacggcgttgtagacaattctatcgtcggcttaacacttgccataaaaagccatattataggataaacctgaataagcagaaaggcaagaataactatcgcaaatacaatttttccaattttctttttcatgattctttacactccttccgctctgaaaatattttacgaagtataaataccaccaacatactttcaataatgataaacactgccagagcactaccataaccatattggttattggaaaatgctttcttatacatgtatgtagagagcagctcgcttgcatttcccggtcctccacttgtaagaagaaatggaatatcaaatcctctcagcgcacctgtcaaacacatagtaagagtcagaagaataatatccttaatcaatggaagttttatttttaacagaatttggaaatctgttgcaccatcgacttttgctgcttcgtatacagatggatcaagcgaaattaacgctgcataaaaaataaccatatacattcctgtaaatctccagccttctggcactgacactgccataagtgcagtgtgaatatttgccagccaggaagtaaccattccttccattcctatagcctgaaaaaactgatttatcagccccataggttctgttgcatacatacttctgaacagctgtgcgatagctacagttgtgataatgcaaggaacatagtataaagtcttaacaaatgtcacatgttttttcataaaagtcagtaatacagcaaaaataagtccgattccaagctgcataactaccacaataagaagataaatcagattgtttaaaaatgatttataaaatgttggatcatgaaacattgtaacataattttgcagacctgcaaaagttttatcaccaattccgttccattccataaagcttaacctaatagactcttcaattggataaaaaactgacaaaatataaaataacagtccaggtaataaaaatataaaaaaccattttctgttcttaattacgcccatattgccctccatggttttaaatacaggatgtctgggagagtcttctcccagacatcaaacatccttagtttttcgcgttggttgcaatagaatcatctatcagtttgcagaaatcatcaactgacatatccccggatgcaagaagcaataaattatcctgcatagttgtattagtatctgcatccagatatgtatcccatggtttcaggaactgcgcacctgttttatccatatcatcacgaattctaagatacagatctgagaattctacatctgacggaagttctgttttgattggtgacatctgctgttttgctgcatatttttcaccatagttatccagtacgtaaagtataaagtctttggtttttgcatcaaatgtttttgcattgaatgccattccgattccagagtttacgcaaaattcacttgcatctgtttttccgttttcgatagttggaagatagaaataatctatttttccagctttataagcgtcctgcatagctgcaatctcccaatcaccaatgtagtacattgcggattttccatccaggaacatcgactgtgcagttgcataatccgttgctgcaaatccatcattaaaatactgtccaatattcttcatgaatgttgctgcctctttaccttcatctccggccattttttcttttccatcacgaagattgataatataatcgttaccagattctctaaacggcatcattgccagatatctctgtaccggccatctgtcaacaccatctactgaaattggtgttactccattttccttcaacgttttacatacatccagccactcatccatagttttcggtactgataaaccatatttgtcaaaaatttccttattataccaggtcatttcaacatgatattccaatggaagtgtatacatggatccgtctgtaaattcctgatatttcagagcagtcggataaaaactatcatatttaccattatccttcaggaatttttttacatctacaagcattcctgcatcaaccagttcctggcaatacggatctgcgtcaatatcaatgatatccggcatatttccacctgcaatcaatgttttcagtttctgcaaatatgatggtctatcagctgtagtttcaaattcaatcttccattttccacccatcttctcactgtattcatctgcgatttcatgcattacctgatcaatcgctccgtcaaccggtcttgacgtaaaccattttacggtagtaacgtccccgctgtctttacttttcttttctgcatcagcagacgtcccacatcctgttaataagctaccagccatacacaatgccaacatagcactaattatcttttttctcatattactcgctccttttttctttatattgaattaattttacatcgccttgtactacataaatacctgcataaccatctttatgattatacatcctggtcgaaagaacaatttcatcattaatatacactacgcagatatctttttcttttatgatgtgaactcgatattcttccgcttttggcagttttcttgcagtttctatctgataaggaacatctccctttatctgccactgatatcttccctgttctcctcttggccacatatcccatgcaactaattgatttttagggttcatacgtaagaaataacccgtttcgagttctttatccacatgtaacgcaattccaaattcatggtatctctcaggctttattaccatatccaacgcaaaagtatcaccttctaaaggatataaaagagcccccagcgtatcactttcaacgctgactccatcctgcgcctgtaccatcttgcagttatataaagtttcttttttcaattcaatctctttcgaaaaataatccagcacttccggaatagctttaattctaagttctccgtttttcgaattctgaattatttcatgaaaattcattgttccgccccattcccatggaccaaaatcagtatttccatatttgctcgctatccatccgaaagcaaatcgtcttttgccatcagaagcagtcttgattgcataatcagctcttgtatcaaaaacatcatcatcaggtatttcccatgggccattccagtttttcgaaatacgataatgtgttgtaaactgatctgaaaatgttgaaaataccagataccaatattcgcccattttaaacagttcaggacattccatcgtaatatacattttaggatcataaaaaggtttctcataagtccagtttattaaatcttcggacttacacaatgcaatgcatccacccctgagatctcctctgttcgtcactcttgacgccaacagcatataatagcattggtcttcgtcattccaaaaaacaaaagggtctctccagtcaaactcttcatactgttttccatctgagacaaacaaaaaatcttttactgtctccaaattttccagatttttccctgtggcctgcattacagattgaattgttttaccgcgaagtttaaaatcctcattataagcggtataaaaaacatgatacaatccatctttttcacatttgataaccgatcctgtatatgcgttcttgttggcatcatgaataccacctcttgcaattgattcacctttataatccagattaacaaaatctttggtctcaatcagatgccatgtagtctcttcggcatattctttatcacgtattcttggatcatgaagataaaatccataataggttccgttttcataatatggaatcaaatcaccaacccaggcattttctggtttataaaataatcgccccatttttaccctccttttgtttataaaataattgcctcatttttaccctcctttttgcaccatttgcacatttcatttcatgcatttacatcatcatattccttgcattatttcaagtttttgcacagtattttctccttttccctcttttctatattttagcctcacattttttgtgcattatttatattattctcttctttttccgtgcattttgtgcattttgtttttacgttgtattgtttgcaattcgtgcattttgtgttatactatatctaaagcatataaatacaatataaaaggagtttactatgaaatgtaccattcaaaatattgctgatcatctggggctttccagaaatactgtttcaaaagccttaaaaaacagttctgaggtatctgaaaatacaagaaatctggttataaagaccgcttctaagcttggttataaaaatgccactttcgccacccctgtcatacctgcctccgaaacagacagcaatgtgacgattcttttccttaccagaacttacgcttccgactccgaattttggaccaccgttttacgaggaattgaatcgattctttcaaatgcgaattatcatctggcaatcagtatcatgtccgacagtgatctaaaacaactcaatttcccacaaactatttccgattcttctatcaaaggaattattcttgttgagatctgtgataaagttgtatgcgatgccctctcacaatttaatcttccaattgtatctgtagatatgccaaatgttccgtttgaagaactaaacggaatagatgtagtcacaatggaaagtaaaaagaatctaaaaaaaataattaatcaacttatagaaaaaggagctgaaagctttggttttgttggagacctctattcccctaatgtaagccgtggatttcaggaacgttataatgccttatccgagtgtcttgctgaacatcagcttccacttaatcaaaagaattgccttcttcatcaaacgccggaggattttcggaattttcagaccacagttaataatttgcaagctatgatatcactgccagatgtattcatctgcggaaatgactggactgctatccagttgatatacgcactgcagttccttggtttccagattcccaaagatatatgtgttgttggatttgataacatccctgctgcttccagaatttcaccgtcattgacgaccataagcactcctcagaaatatctaggtattgctgctgcaagacaaattcttgaaagaattcagcatcctaattgccctcatgttttctgtcaatatgaaacagaattgatcattcgaaattcgactaatataacatctttttaataactcaactatatttatattgatatatcggaaagattattgttgatacactgcctgtcaaaaagtcgagttaataattgtgtttttgaaagcggatgactatatgaaaacatcgtttgcatcgagcttcttcgccgtggatacgatgtttatgtcggcaagctctatcaaaagaaaatcgactttgttgctcagagaggcagcgagaagatttatattcaggtcagcgacaacatttccgggcagtaaacatttgagagagaatactctcctctgcttcaggttcgagatgcttatccgaaaattattattgccagaaccaaacatccccaatatagttatgaaggaatcgaaattcacaatatagccgattggttactacaagaataagcagggcgaaatatcagtagttaatgaaaaaccctgcttacatggaggtgcattagcataataaaaccgcttgtcagaaaagcgttcaaatggtagtcttttcatgggcggtggtgtctttctgtattgaattgttttgtgtggtaactttacaatatcaaatactggtaagaattgccattgcctattttattattgagaaaaagaatgccgtaaatacgaaaaaaaaacagttcgtaaaaatatgcttttacgaactgtttgtatttttggtcagttctgcaaacttgaattgagatttcacctgttttaagagatttaataactgttatattttgttattaaattctccacaagcccttgaaaacactggatttatcgcaggtgagcttttccttattgtttcccttgtgttatatcgtcccatcagtgtttacgaactctgataagggcaaatacaagggcaagaaaaatctataaaacagtataacacaaaataaaagtgacatggtgaactgattgaaatgcttctgatttttgtaactgataattgattgaatgataaggagagataagatacgatgagaacaatatttgcagaatacaatccacagcgcaatagtattgatgtttacacctctgctggctatatgctccgcattgattgctgggaagctgaaaagaatttaaaaactacacccggatcagactgtgcattaaacgcacttgctattgatgaaccacttgaatatgtacgattatatttggacgggaatatgcagatgtgggtagatgcagaagattcattagaactatggtgatttttcgacggtgtgaaattttttctgtaaattcagatcttctatgataattgatgcggcttaacagcagttttctgttgttaagccgttgcttatttaatagcaaaaataagccggtatgtcaagagcacccagaaaatctgaacgtacatttactcttgatcatccggcttattttcaacagcactaagattaccttttttaatattgtttgggatactccctccataaccgtcacatcaattttatactttacttcgatttcaactttttctggtggattgactaaaagcctgtcaatatcattttcctcaacaccagccatttttgctatcattagcttggatatgccataataggaaacaagcacttccaaccaaagtaccgatttgatattttccttttaccgaaccttcttatgccttaatatcaaaactcgatctatcaggtacagaaatactcacagatcctgctacaaggctttgtgtcatactttttacatcagtaccagttacggataaggtataatcacccgtttcctttctttctgccgatttttctgcacgtttctttgcagctttttcttcctctgcttttttagcagctcttttctcttttactttttcctctttttctctgttctcttttgcttttcgttcagcattctctttcgctattttcccatctggatcatttgtaccagatattgccaccgaaatatttccgttttcatcaaccttataactcagatttgtcaaagtgcccaaacatccattcaccgcactttttgcacaatctggaatggctgctaagttttcctccagatactttgctttttctggatcattcatacacttctgtaaaaatgcacttgaaacggatactgttgtcggaaccccttgcattgaagtcgttcccgtattcatataatggtattttccttgcaagtattttgaataatcatttacattgctataccccgtcttaatctgctctgtttttgtcacaccgggacgtgatgtttttaattcaactgtacttgttgtcacgttgccatcttttgtatttgtactatccttttcactatctgttttttttacagtattcttataatttgaagcataatacgatgtgtaactgctgttattgatacccgtaattgccataatcctacctccctgttattgaaacttaaaataatttctattatattgaacgacttggatatttaatttccgttgatgtaaattcatcttctgccgaaacattgatatgcccactgctgtcaatagcatactctttaccataaacagaaaacgtatctccttctttatacccgatttctatccagtttatatcatttaactgttttatcttggcgtcaacatttatggtctttcctgattcctgcaataaataagtgtgttttcctgctcccgtatctatagaaaagaatcccggagaaatcccgactttctcacagactgacagtacttcctcattactgtagagataaccccacacactctttccctgtgccagatcagataaaatattacttgctttgcgcatttcccacttataatttgtccctttttgatttgtattctctgcaagcaacgattccgaggctgcccagcctatccttccattgttgaccgtccatgtatatttaccgccacttgatgttgtccatgaataataacttttattacttaataccaaagaattatttgcagcacaaatgcctgacatggtgcttgtattcattttcggtactgcataattaggtactacctgtctgctcccattaaggtcaaaggaaataaccccgtactccttaaaatcagaattatatccacaggaaacattctccccaaaattgattgcatccaaaatagcacttgaattattatagtttgcaaaataataagccaattcactgttagaaatattcgcatttttatctatcagtgcagctattgattgctttgaaaagcctcgtgcagcatcagaaatacttaaactgtcctgttttttattatttcctgctccaagcaaaatctgtattgctttttggtgtattcctgcctctgcctgttttgaatatgtcaatagctggtttactgtgtttacatctgttactgtcttcataattattctccaaaccctttttcaacattatactttccgtgtcattatgttcttagtatatcaactataataaatattcccctgatacactaaaagttttataattcaaatatatattttcatggcaaatcaggtgcaacatacctaattgtcattgtcggagaaaatgtcttgctggacgaactggtagatactatcttggcaccccatacttgatccagcaacgaagaatttgtaactggcagactatatgaataagtcgactttgttgctacccattgatcataaaattcattataaaagtatctctttgaacttacagatgatgtacaaccaccaatgcttattttgtatcctattgctccgtctggtatacttgtaataagcgttaaatcaactttatcctgccatgttcctttagccgccaatgtagtagatttaaatgtatgcgtataacttccaagtgtgtacttcggattaccaatagtaaaattatatgttgcagaaatacttgttatagtatgatatacccttaaataatataagccatatctccatcataattctaaagtgcatacatatgttgtaatttactcaacatattatttactctgctttcaacagcttctggctgatttcttaattcatacctgcttccatagtaatcatttaaacggtctttcatttcattacaaaataatttttgatctgttttaccatttaaaaactgattgcagataccacttatctcattcttctcatttgcataaaaagctgtctcatctgagattatttctgacttgtacttataagattctgttttgcttccaattccaacaaccatgtaatctggtgtcattttctccatgatagaattacgtgccgaatcattaaaatgaacatattcgtcaatcatgtctgaaaaacctgcttgtaattgctctggaacatacatttcatttacttttcttagccccgcttcacttgcacttaacaaaaatacagattcataggaagttcctctatatccctcctgagcattcaaaaaatctacatctgctgtcattgcattaatcttctcttttaaatctttcatttcatcttctatcaaatattcagaagcattttcgtccagccatttttcaaaaacctctgactgattttccgaacagccttcaaacgcactttgttctccagaaatggaagttgctttcaaatctaatttgaataaattttcacatttatactctgctggtatctctcttatttctccattaatagatgaaaaatgcattgtatgaaaatccgataccttattacgagcagtctcaactaactttcttgccgaatcactgatttgtatatcatcttcctgaaccaaagcatgagaactattttcttttttctcaatatttctgcttgtcatatcaggattattaatatacatattactctgaatcttcatagcagcctcctaatccactggatcataattgtaatttgcctgtactccacttacccttgtccaatgaagaaccactccattgtcatataatgggtttggtgtcattacatcaacaacttttcctgtatcagaatcaataattactgttgcacaattacttgttagaccatcatagttacttgaaaaactattaactctccaattagtattaaacaatcctacaacaagggcatttttataggaattccaaccgctgaaaggcgcacttacattgataaatgttggaacttcctgcattacctgcatagcttctgattgaaataagacaacattttgatcctttgttttatataaattaaagtaaatatttccattggacttaacagttctttcataagtaaaatctatcggatttccatttacataaaaatttgttcttgaaccgtcaaactgaaaaattgctgccttatctggtgtataccacatatatttcgcattttcatcatctgccaatttgtacttttgaaattttattccataatatttgtcatcgctataattcatagaactagccataacaatgaaataatatgtacctgtatttaatctgtatgtgccattattgattgtataataattctttccatcatatactaagaccttataatcacaacctgttggctggtcaaaagtatattccagaatatcatttttgctaataactactttgtaataatcataatcaaatggactatcaatcgtagccgtcatacgactatttctcacataagaactcgccaagtctgttgtatcattgatttctttgccgtcattaactcctgcatatgtatacattaaaaagctaccatttcctgtcgctgcttctattccaataaaatatataccttcatcaagctttaacattgataactcttgcgttccggctcctactattgcacttccacccacaagttctaatgttccatctgtttcatttaatttatatacatataaatcaaaatccgctgtatcatccattaccattgccgctgtaaatttagtcgcttttgcaacgctaaatgcataccaacgctgttctaattctgttgcaaccgtatcataaacctgtgttcctaatgatattgcttttgcatcattaggattatcatttactgtcttattatcttcagtattatccgccatatctaccaaatttacagaatagtcctctgtacaaatcttttccatatcattaatatccgaaggcaaataatctgcaacttctaaatcctcattatcctttatcgcagaaaaatcaataacaccctcctgcgatgctgcggtttcacctaatttttctgttatcactgcattttcatgagcatgaactacaacaggaccacctgcattataccctaacgataacgccataatcatagcaatagttcctgccatcttctttctatttttcataaaatttccacctttccttttatgtcagtagtttgttctatttttttcaatttttataagctctgcattttgtctgaatttttccacataaattcagtagtgcagcaactatcataccatttaataaccactggcatacttcaatatgaattttgtgtgatataataattgccatatctgccaatactaaaattattaacgcctgttttctaaattttttctgttcctcttgatctaatgttcgattttcattttctattggagcaaatgcaaatataattgcatttgccccaaatgtagttacagtacataagcatagtagaaaaatgactaagcactatttatacttactatttgcacttgtcaaatcaagataagcatccatacttttcgtccaaagcaacgataaatcaaaccttcccaatttgtttaaatcttctatgcattctttaaacattgaaataaaatctcttctgtcattcagtcccatattaccagcttcaagcggcaaagacgtaaagcctccctgcttctgtactttgtaatgtgcctccaatgcacgcatttcaactactgtagcacttgatggatcaacgtcattgatataaattctttgctcaaactcttttccattttcatccacacctttcgctaacaccacaggattttcatccgtcgaatcatccgcatatttaagacaataagaaagacctgtaccattacctcctgtccacaacatattatctgttgtgaatatctggtatacctttggtgtttcagccgtataaaatgtcttttccgcagatgcaggggctttcatattattgcctttttgttgaccataccatgaagatactgtatttaaatcagaaccaacgtacatacttctgttcctcctatttcaatatcatttttgcatcatgcataaaattattctcctattttggatgccaacactgtataaaattctttttcctgttgcagatatgctgtcctttcctctgtcattgttgccaatggattttctattctctccaatattttgttgatagctgccaaacaactttctttcgtttctccaaaaatattgtcattaccacctgtcagaaaatcctgctccacagatagctgcgttaatgtactggataaatcagtctgaaatggattaacccccgtttcttctaaagtttcctgccacgccgcttttacactctccggcactgtttgaaggtaataatcgctaatataagcaatctgttttttggttttttcgtctgcaaactgataggttctgttattcgcttttaactgttcatatgccgtctgcgcctcactgttcgcttctgactcataccagccatctttatttttgctatatttcattccattgaccgtaaaatctttagaagtgtctatacccagataagacataacatctgtaattccttctatgtactgggcatattcctcctttgaatgtgctacagtagtcattgtcccacctgcatttcgtagcattgatgccaatgcacctgccattctttatgcttttacataggattctgtatcatacggattatctccaccagatacctctactccatgcgccgtaaccgtaagcacatgacctccattaacacgaatactttgtccttctgcaatattaacagaattattctgtctgctaagtgaagcacccttcgccaattttattggtgtttttaacgcttgtgccagatcctctaccggatttagtaagtgctgcgacatcgccccattatatgcttccttatctttaataactgtatttttataattagatgtaagtgctcttgtattgggattaatataatatgatattgatagcatcatcacaatctccaattattttcattcctctgtcattcggaatctattcactctccataacggtccaagtgatctattacttttatgaccatctataccaagttccgccattcaaaagctgtgacatactttcttcatatcttttcactgctttctgctgaatggaactaggcaccacataatcgttaccaacttcacgtattttcccatttaccagttcgcaatgtgttccgtttatcacaaattctctgcttgtatccactccctgtgacgcaagaaaatctaaaatataatcggtgtatgtatctgtcatacttgaaaaatactgctgatccgcaaaatgtatcagggagttcagaccacctatcatcatattgcatctttcatcatctgccttgcttccgtttccatagccctcgccccagacaaaatcttcctgtaccgtcatgctgtatccatttccaagattaaatctgcttccaaccccaatcgtgatactgtttgtactgggatcatatggtttgtaccctctggttttaaatggctgctgtacggttccaaaggtttgaatctcggatgggagatatgacatacccgtaattgccgtaaacgctttctgcccattcacataaaaggaagtatgggttgcactgtctatatccgctgtaatctcgactttctcatcattggcaaaaggattctgtccggtcattccggttccatatgcaaacagcattcttgtaaactgatatcttgtatgctcatcaaaatgattcagtgtctctgtatcttctccctttacatctccattgcaaaaatcaacaaattcatttttgctgccatcttttgtagataatttacctgtctttgtgttataaatgaaattataggaacttccaactttcgttatactcataaaattgttctcctttctgcataggagtcagtaatatgctctgactcctacatgaaatactttttaaaaatctaattcattacccggatatggctccataatacacttaaactttccattaattcttcccgaccaatgcactccactatgcgtattttgtgaacattttgctccaaatgtccataattgacctattgaagcattggttatgcccttaattgcattgtcacctggtgtattgtaatatgttcttcctcctgcactcatatatttactcaggtgtgaacatgttccttttgagaaggaatcagataaattaatatttattattgccgttgtagatggaaacgcatttctcaaatcacatgtataagtttgatacgcagttccaaaaagatttacccctccatatgttggcatatctacaatatcaaaagtttgtatagcaggaccaacatagaagaaataatacatggaatctacccaatcatttccactacaaatccttatgtaaaatttaccggtatcttttgcagtaaaataaaagtatttttcagcagctcctttataaacactattatattcaggatttgttgaataaaaatatgaggaatctaaatcttcacccaaataatataattctatataccaatctctgcgtccaacatttcgtaaatctacaaaatatgtttcacccgcagttaatgaagtgtaaaaccaatcttcatctgtttctgaatgaagccctgccgctttcattcctaaacgatataaatcattattgctggttacttgagtcgttaatgtttcaaccttgctatatggaaatgctgtagtaggtgaatcattttcttcataatcatctggagttgttccatatgtttggatttcatcatcagacaagacatcatattgttccttcgataaactcataggagacatttcttctaacttaactgactccaaagactcagtaactacttctgggttattctcaattacagcatcttcagtagttgttatttctgccgccattataggtgtgcaaaacagcatactgcataccatagccaaacttaatattcttatttttttcatcattttctccttccatttacacagtaatattttcattacctatttcagttttttaggtcttttaggctgatgcaaaataaccgggcaatagcgagaagcttcatttccattcttctctacctcaagttttacagctttttgcattaagcttaataactctttcttaatattattactcatcacatttcacctcctgtccagttatttttcccagtgttaataaaattgcacacaagatcattccaaagctcataaacagaatatatttttctgccattcccagatatgtaagtgcaataacaactagcaattccacaaatactgttatcctggcaagtttcttattttcctcgaattcttccttattccaatccatgccaggatgatttactgctcctaatacaaaaataaccattgccgatacaagaaaaataatcatatttatcttcatattattaagaagatatgggtatatcaattttatatatataagataaatacttaccgttccaataaaacagcttctaaaactgtttgcatgatacccacctgtgcactttcttaaatttgataaagatatagtaaataaaacagtttcaaaaaaatatccttgaaataacgctatcatataaatagccgaaaatcctattatcttttcaacaataagttgtatggaatatgaataaatactctcttcgctttctttaatcagaccatccatatacatgttctttgtcaacatatttgcaatatattctgtcatgacttcatcatctccagttcactttatctttttattcgtcatttcctgtctaattctgtatatccattgcagaattggaaattttaaagcagaattggaaataaaaaagtagatacaactataaatcgcatctacttttcctgattatgtattaaaattgcaaccttaaaattatcatcatcatgttttatcacgcaggaaccgtcatattttccaacggtttcctttatattttccagtccgatcccatgtctgtctgcttccttagtttttgttgttatgtatcttttcccaacgattaccggggtgactgaaaatgtatttgcaacagacaggacaatctgatgttcttcttttacaaatttcatttttatgattggtttttcgcactgctcacatgcttctatcgcattatttaataaatttgacaatatcagaacaatatcctcatcttttattctcaaatccgacaggtcatttacctttacaacaaatacaatgcctttttcccttgtctcctgatactttgagtttaatattgcattgacaattacattatttgtatcaatgaaatctgtgtgctgcatgatttcatgattgtattgcttcagataatgattgatctcgtctactctgttttcactggctaacgctgcaatgagtgcaagctggtttttatactcatgttctctttttttctgtttatcataattttctgaaatcgtccggtacattccggtttcatttttaacccgctccagcaataagcggttctctgttatctgtacttcccgcttcaatatatcattgatcaggcaaaaaacaataatattcatcaccagtagtccaaatgcgatacagatcaatatatttttctgatgatcactttccggaatttcaaaatttgtcagaagtgcaatcaggacaatgattgtataaatcggaaagattgtaaatcttacccattctaatgtggtaagcatttccgaggatttttttacaacatatcttcgcagcaccataataaaacagacctgcagcatctggcttaaaattcctagcattgcatttatcagtggttccgataaacgttccatcgtaattgtcggaaaacatttagacagcattataatagaaatataatccgtcacaaaacagattccctgatataacaaaacaaagattgctgtttttatccaccgctgtctgaaacacaaacacataaaaagcgttccagtcacaatgattgctatttctttcagtataatgtcaccatccagttttacggaaataaagtagtctgccaaaatcatagctccgatgacagcatagcggcaccatttacccgacaggtctcttttttctgaaaaagtcccgataaacatcacacacaatattacaaaaagcactgtatacagcactccaaaaatatgcatttccattaaatttcacctctgtaacaagcaaattcgtttcttgtatctaaaaatctcgcctttgatattgcaagactttttccatttgaaagcacagccctgtaacgctccacactttctacatatttcaaatttaccagataacttttatgaatccggcaaaagcctttattctgcagtgattctgctacatcatccagtttcgtatatattgtataatgaactgcatcttcacccgccatgtaaaatatcagtcgatgcagattgctttctatataaagaatattttccagactgattgttgttttcccctcctgaaaatcaaaagtcatttcgttttcttcataatccattttttcaaggattgtatccatacactctgtcattgctttttcaaggctttcatgatcctttatgagataccttactgcatccaccttgtatccttccaacgcatatgtaataaaagccgtcacaaaaacaataaaaacatcttttgttattttccttatttcctttgctgtctctattccatctatttcttccatattcacatcaagaaaaataatatgatattgattaagttcttctctcagatttaataattcttttcctgactcatacatatcaatcatacattcgcagtttttccctgccatatattttaatataagctgcttttcggttattcggaaatattcttcatcatcgcatattgctattgataacattgcattcacctcctcatatcatagtctactctgtgtgtatatcggcaggtcatcaattttttcatatattatcccataattattatccgtgtcttgcagtaaagttcaagtgttattgcagaattgggaattttggagcagaatcaggaatattatataacttttgatttcatcatgttatttgcttcctgttaatacgcaaaaacactgtatctcaaactcattgaaataccatgcttccccgcattttctatattgttctattgatattattactttactatccgacacgcctcttggcgtgactgtatctatcaaaaaagaagccagcagtttattcacacactactgacttcctatactactcattttatttacttcgctgcgtctcagacaagttttccatcactaaacataacctctgttttcccgccatccttttacataccacctgattccaacatataccagttgcacaaataataagagaaatagcagattgatcggcaatactgtctttatcgaatctccaaagtagattgttattgccatgcttataagtatcaccattacagtaatcatatcccaacagtatttcttatataaccctgcaatcttcatccatataaacactacaagtattcccgcacccaccagacatccactataaaccagtatttttatcagccagtatataattccagcaacgacaggattggatattccattactaatctgtgccacggtctttcctgtcagtacaacccagccagcaatggtctgtgtgaaagttgcgattgtatcaaagaataccacgcaatcagaaataaatatttttgaccgtatcatctgaaaaagagtagttgatatggaataccatatcaacagaaatatcaatgcttcatacatgactgtttttgctttatatctgcctgccagtttttctctctgtgtatcatacctttccttcgctttcagataagctgtctggttacaattccagcacttttgatagaataccggcttttcaaccggtatctctacttttttctgatgggagagtgcataatcccgttcctgttctgcctgccttagcttatcttgacattcctctgtcatgatttcggcagcgtgcgttttctctttctcgctctgcaataattcttttgttttcctcaagtcgttctttaaggcttgaatgttccctgctttgttctcgctgtttaacttctcgttcaaggtcagcgattcgtcgatctgcattttcaatttctcgatagtccggtctttctggtcgagttcttcctgcatctgctctgtcagcattagcagttcttccagttgatcgtcgctctttgagttttcgtattctgtcatctatatccctcgctttctctatctgctgttcaatgtcagtaattcgctgttctgtttctgtaataatcggttctcgctgtttaatttctgtgctaattcctgccattgctgattctcgtctgtaagtcgctgtatctggtctgccttttcttccagaagcatcagcagttcttctgtatccggcaagatttgaagcagctctgataattctttctctaattgctgcaatcgttcttcctgctcctgaaagcacatcagcttctcgtccttttcctgtatctcctgaagcatctctgccatgatattctgttgtccctctatctgtgtaatcattgcttccatcatgggaattacttctttgctttcttctaatgtcattcaaacactccctccacattgacaatgcaccggataccttaccaaaggttgcaattaccttttgtaacagtgcattttgtttttttattatctggttttcctcgaccttccatgaacctttccttatctgcccggtgagatatttttcctcaatcttccttgcatctgcaccctcatgaatcgtagggactttcaatttgccctgtctttcataagagcggtggtcaatcagattgtctatggataaatgccggttacacatctttgcccattcgcttcgccataactcacaattctttggattgttccagccggtagcgtcagtcagaacccttttccattgttttctgtttcttgccccgactttctgtactccgttttcatcaagtaccggaatacggattccatgacggtctggatttttcttatcctgccaccagtccgggtgggattcatcaaccacgatatttccgtcagtatctctgacaaaatcccagtccttgacttccttgctgccccatgagtggtctggattgaatggtcgcatggttacaagtaaatgcacatgtgggttcccgtcgcccttatcgtgtatgctccagtcggcacacattccctcgtccacgaaagtcttttgaatatattcggttgtataatcaatctgttcctgtctgctccattctttcggcagggaaaattcaaatgagcgtccaagctgtgcatctgcatttttttctatcttcaatacctcattccatagacgctgtttctgaaatgtgattttaaacttttccagtgcggcatctttatcatccgctcttttataacggatagactgttgaaacctttttatattttcttccggtacatgcagccattcaggaggtgcattttcgcacatcatcagactggtgtagacgacttcctttttggaagtatagtaactgattctgcctgtttcctcattcttcatcacatctccattaagatatgccgatgcggatatgacagattttcctttactgcgcccgacaatctttactgtaaagtgaaatatcgccatgatacgattccccctttctgccgtatccggcattgatttccgacagcatcttcttctggtttggcagaagtgaagctgtcggaacgccctctgcgcaagagtgccccctgcggcatgagcaggtctggctgaaagccccgccgacggaacgagcccggcaagcgtaagcgcagaccggttgccacttgtggcaaacttataaggacgacctctggttgtccataagtgcgcccttcattcaaaggcaatgaagggaatggaaaaaccactccctccgccattacacttcctccatatctgtaagtggctctttctgcatcgcctttgagaaaaactttccgtttgtttcctgcctttttaagaagcctatcaactttggtaaatcttcctcctcaatcggacagccaagaaccgattccaccgcaccgccaatctgacagagcctgtgggttcgttttttactttcctcggctttctttctcttttccagttcctttcgctgtgcaatgagctttttggtagcttcgatgctttcctgttcctttttctctaatgcacgtattctttcttcataagtctttgttgatttcgccatatcgtcttcatcctttctcttataatcaaatcttgctctgctaagatttggcacacgattctggtcagctctgttgacataattccaatcagaatcgtggtgcatccttgcggagcattatcttgtcgatgtttttccgacaagataaacattagttcccggttgcatatcaggagaagcacatggtataatcctcttgcgtgtaggtatatcatggcttcggtctgatagaacctttggcggtttcgtaggaagccgcctttttaagttgccacatttcttgtgacagtttttacatttcctttatccctcagatctcgcccctcgttggcttccatgaacttttccagaatgtcagttttaataaggacttttcttccgacttttaataccggaagtttcttccattcaaccagctttctcaaagtgtttctgccaattcctgtatagtcggctgcttcctcgatggataatgcaatctttctttccgtcatcttgtcacctccttatgaattgcattatgcaatttttgttgtgctgttagtatagcggttttatattgtgttgtcaagcgttatgaaattttaaaaataattattatattgcatattgcaattatgtgaggtacatgctataattcatacataccgaaaaaggaggcaatcagcatgaaagataaagaactacgcaagctgataggcagcagggcaaaacagcgtcgtctggaattaaatctgacacagccttatgttgcagagaagatgggagttaccgcttccacaatcctgcgttatgagaatggttcgattgacaataccaaaaagatggtgctggaaggtctttcggaagcacttcatgtatctattgaatggctcagaggggaaaccgatgaatacgaaaccgatattacggataagaaagaattacagattcgtgatgcaatgggcgatattctcaaacagttacctctcgaccttagtaaaaaggaagatgctttttccaaagatttactgctgttgatgttaaagcaatataacctgtttctggaatcattccagtttgcctgcaagaattacaagggcaacacgaatgaagctgatattgcaaaagtaatggggtttgaatcgaatgatgaatataacgagattatgtttctccgggagatcacccacactgttaatgcctttaacgacatggcagatatcgtaaggctttattccaagaaaccggaaatggcagaacaaaggcttgaaaatcttttatcagaagttttgtatgaggattccgattcggtatagaacgacaaccggagttatgatatacttacacgcaagaagcatttcatcagttccgattgtctgatatcgaaaggagacacacgattatggcaaaaggatctgtaagaaaaaaaggaaagaaatggtactaccgcttctatgtagaagatgcaagcggcaatctggttcagaaagaatacgctggaacagaaagtaaaagtgaaacggaaaaactgctccgtcaggcaatggatgattacgaaagcaagaaatttgtcgcaaagacagataatcttactgtaggagaacttcttgatatgtgggcggaagaagaactgaaagtcggaacactcagcaatggtacagtggaaaattatcttggtgcaatccgttgtatcaagaaacatccgattgcagaacgcaaattaaaaaccgttactgctgaacatttacaggcatttctcgatctgcttacattcggtggggaatttccagatggaaaagtgagaaaaggatacagtaaagattacatccattccttttcagcagtattacaacaggctttccggtttgcagtatttccaaaacagttgattacttttaatcctatgcagtatattaagctgaaaaaacaggcagaggatgtggatttattctcagatgatgaggtagaagaaggcatacagcctatttcccatgaagattatgagagactgatagaatacctcaaagtaaagaatccacctgcaatcctgccaatccagatcgcatactatgcgggacttcgtatcggtgaagtttgcggattgacatggcaggacatcaatcttgaagaacaatgcctgaccattaaaagaagtatccgctatgatggcacaaaacataaaaacatcatcggaccgaccaagcgaaagaaagtaaggattgttgattttggcgatactctgactgaaatactgaaaaccgccagaaaaaaacagcttaaaagccggatgcagtatggtgaactttaccaccgcaatttctacaaggaagcacaggacaaaaacagagtgtattatgaatattatcatctggacggaaccgaagaaatcccggtagattacaaggaaatctcctttgtctgcctgagaccggacggatgtctggaactgccaagcacactcagcattgcctgccgatcagttgcaaaaaggctggacggatttgagaatttccatttccaccagttgcgacacacctacacaagcaacctcctctcaaacggagctgccccaaaagatgtgcaggaactgttagggcactctgatgtcagtaccacaatgaatgtctacgcccactctacaagaaaggcaaagcggaactccgccagacttcttgataaagtggcaggcaacgactaaataaaaaattcccttatttcccttgctgattccgcataaggtcaaaaataagggaaaatacatatcatttcactatttaaggggctggaaagcccgtaaaataaggaaagttcaagaaatctctccacaaattccaatttttatagatataataaatgaaaacaacattccaaatatagagcttgctataaccacaaacggatacaaaatcaaattttgaattttaaatggctctattataaaaacaggcaacataaccattataaatattgatgctcccattacatactgtagattattatttacatatacaatactacctgtaattaccaccgcaatgatatataccatccatttgacagctttattggtaattcctctacttagtacagtacgatatgctaatgaataaagtacagtctctgttataaaatatactatcaaatacaatatatcccttatcacattcttcgcctcgccattctttcaccatactcatgatataacctttttacgttttctttatagcttctaccaatcggaatttcaatatccatatctcttatagataattttccatttctaagtgtggcatattcaagattaaccatatatgatttatgaacacgtatcacagaactgtcctcaagccgtttctcaatctcagatatatttattcctacaaagttctgcccattggtataaatatacgcatattttccctgtgcctctatatatcttatgtcctccgcatagattattatgttttggccggtttcagacaaatacgaaatgcctacattctcacatttctctatcaataccttttccagcactgctttcacatccatatatccagccggcttcctgataaaatctatagtcttgattccaaaggaatctatcatcttctcatcatgactcgacacaaatgctatccgccagattttgtccagtttcagtactcgttcctttagtttaattccgctgagaccatccatctctatatccagaaaaagtatatctattttttggttttcctcatcatcacaatattcgagaacctcttctgcgtttttatacattttatattcaaatgcatccgtattgttttcataatatttctgacataattgcagcatatgctgccatgcttccgctgagtcatcacatattcctattcgtaacatatactttaccctcttttatcttattgtgcactgtttctttcccccaacagccatcggcgaagctcgtatatatcccttacaatatcatatatttatgtaattgtcgcggtctacctctatcacggtatagtaattctttccaagctttttcctgacattttcctgtattgcgttgcatatatcatcatctgaggtgatatagccgaatggaactgcaatgtcaaaaaccagattcgtatgtgtatcacctctgataatacggaaatcgtgcatatttatgtgcgaatcaagcccttttatcacggagagcacctcggccttcagtccggctacctcctcgtcctctatcgctaccgggtccatgtggatggtcactatacagcccagctcccttcgtatcctgcgctccagattatcgattatatcgtgtagctcgaccatatctccgtcctccggcacctctgcatgaaacgatactatcctgtgtcccggtccataatcatgcaccataaggtcatgcataccgagtatgtttttgtcaaagtccagtaccatctccttaagtctatcgacaaactccggctccggctttgctccaagcagcgggtctattgcctctctggctgatgatattcctgaatagaatataaacaatgacacaaatacaccgcctattccatccagattgagtcctgaaaagtgcgctatgagtgtggctgcaagtactacagatgtagcgatacagtctgacagactgtccctgcctgtcgcttcgagtgttgatgaatcaagcttttttgaaaaatagaaattgtataccgccatgacacattttacggctattgatgccagtagtatcgctacaataagccatgaaaactctatgtcctgcggctttatgattttgccaaaggaatccctgaacagctcaaagcccatgatgagtatgattgctgcaactgccagtgtagccacatactccatcctcgcatgtccgtatggatgctcctcgtcggctctctgtgccgccatcttaaagcccgctatcgtgatgattgatgagcctgcatctgacaggttgttgaatgcatccgcagtgatcgagattgcaccgctaagcattcctgcaaagagcttgccggcaaagagtatgaggtttaaaaatataccgactataccgcacagcatgccatatttatttcgtttttcaatgtctatttctgtctctggcatttactttacctctatttttattttatatcctgatttacagcttatttcaccgctccgaatctgtcgaacggatagtatctgaatatcgcttttgcaagtatatcgtccttagacacatatgtgtgctcccagactcttgcgtctgatgagccatttctgttgtcaccgagcagcagatatgagtcctgtggcaccttaaactcgtaaggtcccgcatttactgtccacggatcctcaccgctctggtttgacttgagataatcctcctcaagcgcctcaccgtctatatacacctgaccgtcctctatggtgactgtctctcccggcagacctattacacgcttgatgtatttctcagaaggcgaatccggtgcattgaatatgactatatcccctcgctttgggtcagaaaatgtatatgcgagcctgaagccaaatatgtcatctccaatctgtatggtattctccatcgagcctgacggaatatttgcatttataatgacatagttctttatgagtattgccgctacaatggcgaatgcgattgttaacacccagcttaagatttccttgacaggtgatgttttttcctccggcttttttggctccatctcatcggttgtttttgtgtcttcttcgttgtttaagtctaatatctccattttcatgttctccttattcatgcttcaataagtgtttgataatatatgacatggcggtacagcctatggtgccatccaccactttataaagtccttccttgtaaaataaagacttgtaagcccgtaatctgcgatttccctgtctgtaaaggtctttgctatatacgcattgatttcatccgggaagtctctctcgaggcaccactgtgcctgcaggctcattggcttttccagctcatattggtgcacgagctcgcctccaaaatctatgatactgttccatctggatgcattgcccagtatcctctgcttgatattttctatgatcacagctcttgcaatccttacctttttgtacttttcggcgcgctgcaaaagcattgcattgcggttgtgggtatttatcaccagctccatcgggtctgtcagctcatttgacaccagacaaaatacagggtccagatcataatactccggtcttagcacgtagtcgtttctatacgatgctgctgtctttgccacggtaaggtctgccgatacatccgtgtatatgatgcccggcatgtcacccataacatactccatagatgtgatatatggtgtcataaactgccagaaggctctgatattctgctcaaatactatgatatcgtatttgtcaataaactgcccataatcataagggtagttctccctatagtgtgcaaaaagtgccctctgcatgaacgctatctttattttccgcccgataaagccgtttattactgtcctcaccgggacctctacctcgcgctcctttatatatacaagcacctgtacagctctgcttaccagctcgttttccgcctcgtattcacataccagccgttttctgccatctgacagatactggccaagtgtaagcgggctctgcccaaaggcatctatgataatctgtcctatatactggcggagctctatgagcttttcatcgaaggctgctccgtctcttgatatgcttatatttaaaaacctctttttgatattgagctgatatgagaaattgtctatccatgatggtgcaagccccagtatatctgtagcatctgacacaagaactccctgctggtacagcgtggacttatgaaaataccccttgtgctttggatgatatatggcaacatagccctcaagcaggctgttatccactcgtatgatattcatgccaacaagctcattcatcggatagttccactttgcctttggctgtgacaggcatacctccctcgtatcacacctgatatttacaggtataggcagtgtaagcatatagtgctttatggtttctactataaagtccagatctatatacggcgcatatgatggttttacggggatagagatgcgtgtgcccggtgtctttttctgcgatatgacatactctatctggccgctctccccaaaccactttgccatgaccggtgccgtatcctgcggattgcttatgttccaggcagtgtttatgaccttatcctttttcgactcgatgagcacagcctttgagactgtaaagcacgagcatatcccgatgccatagtgagaatacggctcatacttcagctgctgattgaagaaatctgtgcttgtataatagcttgcccctatctgtgcgataaagtgctccaggtcatattcatttatgcctattccattatcctctatcgtaaacagtcttgtatcactgctgtacgtgatgtttatgcgtggctcatatatggccctgacatcgcgcatctggcttgcctgctccatctcaaggaactccgtgccccagctccactcaagtgcctgccgcacattgcaggcatccatggcattgagcaaaagctccctgataaagaccttccacgaagcataaaactgctggcttgcaataagcggaagcatatttgattttcctaactctaaatcgatgcttttcatgctttatccgactgcccgtaatagctgccgtagtaattgccatagtacccactgacatggctgtttttcttgttgtttaccttgttgagcacagcccccagtatcctcactcccgatgcctcgagctgttttttcacactctgaatcatcctggcgctcgccatgccctgtcctatcactattatagctccgtcacaatactttgctacaactgccgcatctatggcagctcctatcggtgcacagtctataattatgtagttaaagtgctccttaccgaaattaagaagctcctgaaagtattttttctcgagaatctctgtcggattcggcacagacggccctgcaaatatcataaaaaggcccggtatttccgtgccatacatcacttcctcaagacgtctctgaccggaaagatagtgcgacaatccgcatatctcccctccacttgccgctgtggcacgcagacgccctgcaaggactgatttacgcatatcagtatctatgaaaagcactctatttcctgactctgtaagcgaccgcgccagatcaagtgccacggtgcttttgccttcatttggtacagagcttgtcacaagaagcgtgcgtatatcatccccgcaaaactgtatatttgtcttcaaagctcgaagtgattccttcatcgtatagctttgttcttttagcttgccaaattttactaattccatctgcccatctcctgatacaggcttccttatgctgaagccgatttcttttttcttttctttctgtggctgcctctgccatgctttctgccctttccttgctctccgtcatcttccgattcatcaagcggaagtgtaccaagcacgttcatgccgagcttcttctccacatcctctgtatctatgattgtatcattgaacagataagaaaccactataaccgcaatcgacagaaatgctcccgcaaaggctcctatcactgtgtttttgccgatattagggcttaccgcgcctccatcatcatatccgctctggatgatggtcggcggatcctgcttcatcttctccgctatatatgctgatgcgacctttgctatctcatctgctatggtctttgccatctgcggatcgggatccgttactgtgatattgagtactcgcgagttggacggattattaagcgtcaccctgccgccaagtgtcttgtagctctcattcagattcagattttctatgacctgatccagcaccggacgtccctttactacaactatgtaatcatttgtcaggctggtgcctgtctggatatccgcaaggcttgtgatggatgtgctctttgaaagtacataaagctcagatgtagattcatacataggtgtaatcataaatctgcttatcgcaaatgccactgcacctgttgctatcgtaacaagaattatccactgccaatatgaaattatctcaagaaacagatcctttaagtctatctctatctcgttgtcaaaatcctgttctctctccattacgtatccccgcatttacactgattatcttccgtttattatattttccggtgtggtctgcatgatttcctgcgcgtagtcatcaccgaacttctttgccacgtactcatagcattttttcatgttgcagacgcgctcctttgtgccatggctgtcgcttgctattacatcaacaagtcctgccttcaaaagcttctttgtgtatctcttgaagtgtctgccatctatgccaagcactgagtctgcattgacctgtatgagtgctcccagctcctgcaaatcctctatacggcttatatcgctgagacactcatatctctctacatgtgctatcaccggtatatatcctgcaaatatagcttcgcgcgtcatcttgtatacaaacgagtattcgctggaatgtgaatactctgtgagtatatactgtgtatctgccagtgtatgacacagcccaccatgaaaggcatctatcatatcggttgccacatgatactctgtgccgagctttaattctattccaagcttatttgcatatggcatcagctttttatagtgtcgctctatcttttcaagcggatgcttaaacattccatggcgcaggtgcggtgtgaggattatgcctgtgatgccctgttttttggctatcttgagcatctctaccgattcctcgagcgactttgagccgtcgtccactccgtataataaatgacaatgtatatctatcaaaattcatggtcctccgttttgttttcctgaactatcattatactatatacagatttttcgtgcaattctttagatattaaatttttcttcttttttgttgggagggcgtggcgtaagcgccgggcatccgtgcagcgcacacgcactcccgcgcctgctacgctacgctgctaagagactgtacgaattatgccttggggtggttctatgcttgacgaaaccggcttttatgcgccgtccatggcgcataacgccttgcccggccgtccatggccgggcatttctgtttttcttgggcataattctacagtctctaagcagcttcgctattcgcctgctcgggagtgcgtgtgcgctgccggatgcccggcgcttacgccacttacattgtgacaataatttacaatttgagatataataaatattcgaggtccaaatatcaaagatatttgaacctcgggagattatgctataatactataatgccatagcactatagagccataatgttataatgccattatgctatataattatattatccgatttgtctgacgagatttatcatttcgattgcaccgagtgcacagtcatatcctttgtttccggcttttgttccggctctttctattgcctgctcgatgttttcggtggtgactactccaaacattaccgggatttctgattcgagtgatactgacgcgattccctttgatacttcgttgcacacatagtcatagtggcttgttgcacctctgattactgctccgaggcagataattgcatcatattttccactttttgccatcttctttgcgatgagtggtatctcgaatgctcccggcacccatgctacgtctatgttttcctccggtacgtcgtgtcttacgagtccgtcctttgctcctcctaagagctttgatgtgataaattcattgaatcttgctactacgattcctaccttgattccatcctgtgtcatttttccttcgattacgttcatttttgttctccttatgttttttatttttactcagatgagtttatctgcaattattaactatttagaatttgttactattcagaatccccgcacacattgcaaaaacgctcgatgcggtgtactaatatgagagtatatgtcccatgcggttctgctttgttttcagataaaacaggtcatgtgctgtggcgctcatctgaatcggcacacgctcgctgatttccatgccaaactctgagagctggtataccttgtcagggttatttgtgagaaggcgcaggctgtgtacgccaagctctcttaatatctgggctccgatatagtactcgcgctcatctccggcaaagccgagtgccaggtttgcttcgagtgtgtccattccctgctcctgaagctcataggccttcagcttatttatcaggccgatgcctctgccctcctgacgcatgtagagcagtattcctctgccctcctcgtctatctgtctcatggccgcctcaagctgctggccgcagtcgcagcgctgtgagccgaatacatcgcctgtgagacactcagagtgtactcggcagagcacatctcttccatctgcgatttcgccctttacaagtgccacatgatgctctccgtttaatctgttgacgaagccatatgccttgaattcgccgtatttggtcggcagctttacctctgtgacacggtcaacgagcttttcatgtatctttctgtattcctgaagtgccgctattgtgatgaacttgatgttccatttttttgcaagctccatgagctctgttgtgcgcatcatggtaccgtcctcacgcattatctcacagcacagtccacattcctttagtcctgcgagcctgcataaatcgactgttgcctctgtgtgtccgtttctctccagtacgccgtttttctttgcaagaagcggaaacatgtggcccggacgtctgaaatcctcaggctttgcgtcatcagagacacatttcattgctgtgattgagcgctctgttgcggaaatacctgtcgttgttgagacatggtctattgatactgtaaatgctgtctcatgattgtctgtattttcctgcaccatctgcggaaaacgaagcttctttacatattcctgcgacatcggcatgcatatcagacccttgccgtgcatcgccataaagttgatgttttctgttgtggcaaattctgccgcacagatgaaatcgccctcattctctctgtcctcatcatctgtgacaagtattatttttcctgcacgaagctcatcaagtgcttcttctactgtgttgaatttcatattttatgtcctttctcttataattttgaagctgttcaattacataattttttaaccattcagccccacgcacatttgcaaacccacacgatactcgtgcttttatgttaaaagccgtattttaccaggaaatctcttgttattccaaccggttgttttttattttcgccggatttatgtggtacattttccttaattgtctgtgctcctgtcatttcttctgttattccatccgactgccctttaaacaacagcttctcaacatattttcctatgatatctgtttccagatttacgacagctcccacctttctgtcctttagcacagtctggcttaccgtgtgcggtatcgctgatattgagaaattatcctctgcaacctttgcgactgtgaggcttattccatcgattgtgacggagcccttctcgactatatagcgcatgagctgtggtgcggcatgtatcgtataccagatggcattgtcatcctttttgacctccacaatcctgcctgttccgtcaacatgtcccgacacgatgtgccctccgaatctgccatctgccgccatcgcacgctccaaattgacatgtgctcctcttagcgcatttgcaagcgatgagcgatttagcgtctcatgcatgacatccgctgtaaacgcatgtggcatgagccttgtgaccgtgaggcagataccgtttaccgctatgctgtctccgacctttgttccagctagcactttttcagctctgattgtaagtactgctgagtttgctccacgtgaaattgtatctattgttccaacttcttcaactattcctgtgaacattgtgtatcgcctttcttttttaagtattcacaacatcactctcgatgaggaaatcatcaccaagctttgttaccttactgtttccaagcatcacggcatgtgccggtgagtcggttcccattccctctatcggtgtttttgcatccgcccctccgaaaagctttggtgcaatgtaagcgtataccttattcacaatcccgctcttaagggctgaccagttgagtattccgcctccctcaagcagaatgctgtctatgtttctttcgccgagcttttgcatgaggtcatttaaatcaatatgaccgtttttttcagctacatacagaatttctattccgttttcttcaagccgtgttatttttctgtttttttgataattattgttttcttctatactatctttttcagtatcaggtaaggcttctgaatgtgcggtttcacgatatcgctcactgactgcaactatcgtcggcacttcctttgcagtatttactatctgcgattccagtggaagcttaaggtgcgtatcgcatattatgcggattggatttactccgccctcaattctgcatgtaagcagtggatcgtctgcaagcactgttcctattcctgccattatggctttatatctgtggcgcaggttttgcacatgttctctcgctttttctcctgttatccactttgatagtcctgaatatgtggctatctttccatccatcgtcatggcatatttcatagcgacatatggacgtctggtctgtataaagtaaaagaatacatcgttcagcctgtcgcactcgtctttaagcacctgcgtgacaacctctatcccatgctctttaaggattttgatacctcccccggcgacaagcggattcgggtcatccgagcccacatatactctttttataccggcttctatcactgcctccacacatggcggctgcttgccatgatgacagcatggctcgagagtcacatacatatccgctccctgtggcgattccttgcaatgctttaacgcatttctttccgcgtgcagctctccgtatctctcatgccagccctctccgattatcctgccgtcctttacaaccacagctccgaccattgggtttggcgatgtatatcccatgccgcgttttgcaagctcaatcgcccttctcatatattgttcatcagtcatttgagttcctttctgcataaaaaagccctgaactattatcattcagggcctagtaatttcaaatatcataatctcaaaaaatatgcactagctgcatttcatcataaatgaattttgagacaaaaaaatccggaatgtatgaaacactccagagtagatatcttttataactatgatatgtgctgtatctatatctgaaactgaatctaaaacccagctatctatactctgcatatatcatattcacatcttctttcatccagactttactgtcggcctcggaatctcaccgaatcatgccttgcggctcgtgggctataccaccggtagggaattgcaccctgccctgaagaataattatttaattagcttacgctaactatagtaatcctttgtggcttgtatgtcaagattattttcatttttgataaaatttatgctataatcatacatcgattaaaaaatcttaaaattttttgtaacaaaacaatcctttctacgtctaacctatgaacaaaggaggtgacagttctggattatgagaaattgtacaattcctattacttgcaagtatactcatatgtaatgacaattgtaaaaaatcaacatcaggctgaggaaattacccagaatactttttataaggccatgaccgcaaagaaggcatatgccggcaaatcaagcgaacaaacctggctttgcagcatagcaagaaatctggcaatagacgaatgccgaaaaagcacaaaatttacagagcttgacgaagagcagctcgaacaacccgataatatggtaaaaagcctagaaaataaagataccgctcttcagattcatcttatactgcacgagcttgatgagccctacaaggaggtctttcagcttagaatatttggtgaattgccattctcccaaataggcatgatatttggaaaaacagagaactgggcacgggtaacttaccatagggccagactgaaaatcaaagaaaggatggatagaaatgaataatccaattacacaatcaaccgatgaaacctgcaatatagttcaggatttactcccactatactatgacgatgtatgcagtccctcaagcaaaaagcttgttgaaaaacaccttacgacttgtgaaaaatgtcaaaatacatacaatgagctaaaaaacgattctattgattcaatgataaaaaaagaggccgacagtgtattaaagcagcatgagaaaaaggaaaaatctgctgcctacaagaccggagtcataatagccggactactgcttatcccaatactcatcacattcatagtgtgtctgtcaaatggcgatggtttaaatacctttgcggtggtaacagcatctatgcttcttgtggctgcaatgacagttgttccacttatggcacagcagaaaaaactgaccaaatgcataatctgcggtgtttttgctctgcttttgatattcttttttgttgacagaatgtatagttcaaatgaatttatgctttggtctgttccaactatatttggattatcaattattctttttccgtttgtcatcagaggaattgagcttccacctgttttatcagacaaaaaagctcttatcactatgctgtgggataccttatggcttttcctcacaatcattgaggtatgtggtcatacaaacgatgttgccggaatgaaggccggctgtattatagcatttgtctttgtacttgcagcctggctcatatttttcgatgcacgatatttaaacgcaaacggatttataaaatccgcaattatagttttgatagcttcggtttggacagcttttgccgatgacatatgcgagtttttaatttttggtaccagacaaatcactataaagtccgtgaatttttctgactggacttccaatatctgcgtgaatgccaatgtttacgctattgtgcttgtgtccggcgttattatcgcctctatacttttcgtagcaggcggtatcaaagcatttgctaataaaaaataaattagttttctcttttatatattattacaaaacccctcccacagacttctatctgtgggaggggtttttatagtcattattcaataagtgcctacagattagcaaacaccctgtgcaagcatagcgtcaactactttctcaaagcctgcgatatttgcacctgcaacatagtcagtctttccaccaactgttgcattgtatctcttagcagcatcactgatgttagcgtagattgtctccataatgcccttgagctttccgtcaacctcttcgaatgtccatgaaagtctctcagagttctggctcatctcaagtgctgatgtagcaacaccacctgcattggcagctttaccacctacgaagagtactccgttctcctgaaggtattttgtagcctcaagagttgtaggcatgttagcaccctctgttacagatgtaacaccgttagcaacgagcatcttggcatcctcaatgtctaactcattctgagtcgcacatggaagagcaagatctaccttgtactgccatacaccgtgctcaccgttctgctttgcatgatactcagcagttgacttagcagctgcatactcagtaagacgggcacgcttaacttccttaacttccttaagaagagcaacatcaattccgtttggatcataaatccatccggtagaatcagaacatgttacaaccttaacacctaattcctgtgccttctcgattgcgtagatagcaacgttaccagatccggaaactgctgctgtctttccctcaaggctcataccatgatctttccataatgcgttagtaagatataacagaccatatccggtagcctgtgtacgtgcaagagatccaccataggtaagacccttaccagtcagcacaccttcgtatgatccacgaattctcttatactgtccaaataagaagccgatctctcttgcacctgttccgatatctccggccggtacatcaacgtctgctccgatatatttgcaaagttctgtcatgaagctctggcagaatgccatgatctctctgtcagatttacccttaggatcgaaatcagaaccacctttaccaccaccgattggaagtgttgtaagagaattcttaaatacctgctcgaaacctaagaacttgataatacccaggtttacagaaggatgaagtcttaaacctcccttgtatggtccaatggaattattgaactgtacacggaaacctctgtttacctgtacctgaccattgtcatctacccatggtactctgaacatgatctgacgatctggctctgtgattctctcaagaatcgcattctttctgtataattcctcatttgcatcgatcacaggtcttaaagaatcaagaacctctgttactgcctgtaagaactcaggctgatctgcgtttttcttctttactacttcgagtacttcatcaacatagctcatttttatatctcctttacaaaattatttttcacatcaacaagtttattttatataaatctattgctataatcaagtaatttttgaaagttttatataaaaaaaattcattttatttattatcttcatttatattatcccagttttggtactgattctcctcatcatcggaatataccaccttgaaataatccgagagttttgcaagtgaagttataagaactttcatttcgtcatccgaaagaccgtcctttatatgctctatcatatgacggtgaaactgctcatgatgatagtatgcactctttcccttgccagtgagtgagagctttaccacacgcttatcctcctcactgcggatacggttcacgtatcccttgcgggtgagaccatctattgcctttgtcagtgtgcccagagtgatagacataagcttggctacggtgccggagcgctttggctcatcgactcctattgcctctattatatgcatatcgttgatagaaatatcagaaaattcgtctgttatcagacatctgccctctatctctgtcaaatccttgaacagacacaccaataattcatttaaagtttcatctgccgtcataaatacctctttctattgccactctatggcgcaggctccccatgtaagtcctgctccaaagcctgataaaattattttttcctcatgctttatcataccatctttgcggactttatcaagcaaaatcggcacacttgccgcagaaatatttccacaatgctgtaaattggtcgggaatttgtccataggctgcttaagcctcttggcaaccgactcaataatacgtatattggcctgatgcaacacatagacatccacatcatctacgctccagccgatttcatcaagcagctcatttatagcctttggcactgtctttaccgcaaacttgtatacagcaggaccgtccatagtgacatagccaccgagtgcagactgctttccattgtcggtaaacggattgactacaggacggttgtctccgtcaagcgcctcaccgccttttccgtccgagccctgtacaaagcccttaaaagcatcgccctcgtctgtcacaacggctgctcctgctccgtctccgaaaagtacacaggtgcttctgtcattccagtccattatttttgaaagaacctctgctcccactacgactgccttgtgaaacctgccggtcttaaaatatgcatccgctgtggcaagcccgaataaaaagcctgaacatgcggcatttatgtcaaatgccactgcactgcctgcacctatctcagcctgaatctgacatgcgagcgatggaacgattttgtctgtggatacgcttgccgctattatcaagtctatctcacttccgtcaatccccgcatcctgcagcgcactttttactgcatcacaggcaagtgaggtggttgtctcagtcgttgcaatgtgtctgtttcttattcctgtacgcgagctgatccactcgtcagatgtgtccattatggctgccaggtcatcgtttgagaccactctctgtggcaggcagcttcctgttccaactatcttcatagaatttcctttccgggactagaacttgcggaaacgcttgtatctttcctccaagagctggtcctttgtcaatttgctttctttttccaagaatttcttcatgttgcccttcatgtagtttccgattgatgaaagggcatcctcgtcggctccgccaaactcaggtattatatcatccacgacatcaagctcctttaagtcgtgtgctgtaatcttcattacctctgcggcttcctttgcacgctttccgtccttccagaggatagatgcaaagccttctggcgaaaggattgagtatgtggcattttccatcatccacacttcatttcctacagaaagagctaaagctccgccgcttccgccttctcctatcatgagacaaaggattggcaccttgatgccgctcatctcataaaggtttcttgcgattgcctcaccctgtccgttttcctctgcttccattcccggataagctcctgatgtattgacaaaggttatgatcggacggttgaatttctctgcctgcttcatgaggcgcagtgccttgcggtagccctcaggtgatggcataccatagtttctctttgcgcagtcttcaaggtcttttcccttgtggacaccgataactgtgaccggctggccgtctaaatatgcaattccgcctacgatagccgggtcatcgcggaaatatctgtctccgtgcagctccataaactcatcaaagatatagtccatatagtcaaccgatgcaagtctcttaatctgtcttgcggcgctgaccttgtcccataccttaaatggcttggcctttgcctcgcgctccttcataagctctgtcggctcgtaattgtcgtctgagtgaagcgggtcaaaattggcatagccagtggtaggtctgtgagcacgtaaaatcttgtaaagagtcttctttaaattctcacgctcaactatcatatccacaaagccgtgctcaagctggaactctgccctctggaagccctcaggcagcttctgtccgatggtctgctcgataacacgaggacccgcaaaaccgataagtgcctttggctctgcaagaatgatatctccaagcattgcaaagctggctgtcacaccacctgttgtaggatctgtgagtacaggcacatataaaagtcctgcctctgaatgacgctttgctgcggctgaggtctttgccatctgcatcagcgaaataataccctcctgcattctggcaccgcctgaacagcagaataatataacaggaagtctttcctctgtggcacgctcaaatgcgcttgtgattttctcaccaaccacatgacccatgcttcccatcataaatcttgaatcaattacaccaagcactgtctcctcgccgtaaatctttgtcttaccgatgacaatgccctcagaaagtcctgttttctcctgagtctttgcaattttctcctcatactcagggaaattgagaggatttcctgttgtaagctctgtaaaccatggctcaaatgcttccttgtcggaaaccattctgattctgtttttagcacgcacacggaaataataattacactcatagcagacgtatttgtgctgttttacaactgatttgagcacagtcttgccacacttgggacaaacgattgtctcagggacatcctcttttgtttcctgtgctgcaccggcatttttgccatctgcgactgtttttgcgctctcagcgttcttggctaaagtctcttcagcctctatatttttatctttcttcttgaataacttcatcttgtctccttatgcaattaacctattgcaaatgtaagctccgccatacaggcaaccttgccgtttaccctggcaacagccttgcccacaccgataggacctttaacctttataatctcagtggtcagctccagcgtatctcccggaaccaccttctgcttgaacttggcattattgatgcctgcaaaatatgcagtcttgcccttccactcatcctgacaaagaatggcaactgcaccggtctgcgccaaagcctcaataataagcactcccggcatcaccggatttctcggaaaatgtcccataaaatgcggctcattcatagtcacattcttcttagccacacactttacgcccggctgcagctcctcaaccgtatcaatgagaagaaacggactgcggtgcggcagaatatccataatctgctgcgtattcataattgacatatacatctatcctttctcaattcgctctaaactatctacatgcttcgcgctccgcaacgtggagccgagaagcgcacagtgtgttctgaatgaaaaatatgaactgtcacggcgttccatccgctccaatggcatgaagcactaacaccatatcacagcctgtccgtgcaaaatgccgtgactgacttcatattttttatgaggaatatactgtgtgctccaccggacctcacagcctacattcgcgaagcccctaaaaagcagaagcaatttatctacatgcttcgcgctcaacaaagtagagccgggaagcacacagtgtgttctgaataaaaaatatgaactgtcacggcgttccatccactccaatagcatgaagcactaacaccatatcacagcctgtccgtgcaaaatgccgtgactgacttcatattttttatgaggaatatactgtgtgctccaccggacctcacagtctaaattcgcgaagccctaaaaagcagaagctatttatttataagccttgagcagaatacttgcattatgtccaccgaatcccagtgaattgctcagtgcatactcaacaggctcctcatagctgtccttgcagtaattgaggtcaatctcctcatcaggagtctcatagccaacagtcttatgtataaatccatcctggatttccttcacacatgttataaactcaacagctcccgctgctccgagcagatgtcctatcatagactttgttgaattgattttaagatttgcagcctcatcaccgaacgcaagcttgattgctcttgtctcaaagagatcattgtgatgtgtgcctgttccgtgagcattgatatattttacatctgccggtgtgacacctgcatctctcatggcattggtcatggctcttgctgcgcctgcgccatcctcctgcggagatgtgatatggtatgcatcagatgagcagccgtatccgactacctctgcataaatctttgcacctcttgcctttgcatgctcaagctcttcaaggataactactcctgcgccctcacccattacaaagccgcttctgttcttgtcaaacggaagtgagcactttgccggatcatctactgtagaaagcgctgtaagtgctgtaaatcctgcaattccgataggacatacactgccctctgtaccaccggctaccatcacgtcagcctcaccgtactggatgcttctgtatgcctcaccgattgtgtttgttcctgtagcacaggctgttacatcattgatactctttcccttgagaccgaactggatggaaacatttcctgctgccatgttacagatcataagcggaacaagcagaggatttactctgtttgggcccttttcataaagcttttgtgtctcgcgctccatagcctgaagacttccgatacctgaaccgatggcacatccaaccatgtatggatcttccttttcgatatcaagtccgctatcatcaattgcctgctttgctgcagccacagcgtactgtgagaatggctccattctctttgcagcctttctgtccataaaatcctgcgggttaaaatccttaagctctgctgcaatgtgacatttataatctgttgtgtcaaattttgtgatgtggtcaaatccgatttttccggtctttaccgatgtccagaaatcgtccacattatttccgattggtgttactgctccaagtcctgttacaactactcttctactcatattgccattcctccgtcaacagacagcacctggcctgtgatgtagcctgctgcatctgatgctaaaaataatactgcgtttgcgatatcctttgtgtttcccggtctgccaagcggaatctgtgataaaagattctcctttgccgcatcggcaagcacatctgtcatctcggtctctacaaagcccggtgccactgcgtttgctgtgattccacggctggcaagctctctggctacagcctttgtgagtcctataactcctgccttgctggcgctgtagttggcctgtcctgcatttccgagtattccggaaactgatgaaatattgataattcttcctgatttctgcttcaagaaatagcgtgacatatgacggattgtgttgaacgcacccttaaggtttgtgtcgagcactgcgtcatagtctgcctcgctcatcttcatgatgagaccgtctcttgtgattcctgcgttgtttacgaggatatctatgtgcttgtactccttgatgagcgctgttatcatattctggcactcgtcaaaatcagatacattgcactgataagaaactgcatcaccgcctgctgcctttatctctgcaacaacggcatctgccttttcctttgaaccattataatttactattacaaaggcgtgtgctgcggcaagtgtaagagctatctgtcttccaattccgcggcttgcgcctgtaaccagggcatttttacctgttaacatacttttcaaaatcctccagtttgtctatgtttacgacttttacgtctctatttatctttctcataaatccgctgagtgatcgtcccggtccgatttccacgaactcatctgcaccgtctgcgataaggcgctcgatggtctgctgccagcgtactgacgatgaaacctgctgtgtcagataatccttgacatctgccggtgacttcacatagtctgctgtgacgtttgtgatatatggcaccttgatatcgtggatttctacactctcaagtgcatctgcgagcttttctcctgcacccttaagcattgctgagtggaaaggtccgctgaccttgagcggtacgcatctcttggcgcctgtctcgctgcatgctgctgcggcggcatctactgctgccttttctcctgtgataacaatctgtccctggcagttatagttggctaccgataccactgaatttgtctcatctgctgtctttttgcagatatcctcaatgatctgcggatcaagtcctaaaaccgctgtcatggctccacctgtaggaactgcctcctgcatgtagattcctctttttctgacaactgcgaatgcatctgccatagtcatggctcctgatgcgatgagagcaccatattccccaaggcttaagcctgctgtgacatcaggtgtgatacctttgtcaatgattgcctgatatatagctgcctcaactgcaagcatacatatctgtgtgtactctgtaatgttcagcttgtcattttcctcaaagcataatgccggaatatccaagcctgtctgttcactggcaaggtcgattactgcctttgcatttggcattgtatcgtaaaactccttacccattcctatatactgtgagccctgtccgggaaacataaatactctcttacccattttcggtttctccttatttctgacaggataccgtaagccactctttgcaggcggcccggtatccttaaatttgcatgtaaaagtgaatactgtctatttgttcagtcccactacatcctcaatgatttctttgcaggtttcctctttctttacgaggcctgcgctctgacctgccatgacgctgccatatacggtatctccgtctacaacggcttttctgagtgcgccaagtgtcattttttcgagctcttcaaatggagctccttccttttccagcttgagatattgtctggtcatcttgtttctgagcactctgatcggatggcctgtgctcattcctgtaacctcggaatctatatccttggccttaatgaccttctgcttatagttttcatgtactatcgattcttttgcggtgacaaagcgtgtacccatctggactgcctctgcaccgagtgcaaatgctgcattgaagcctctgttgtctgcaattccgcctgctgcgataacagggatgctcactgcatcaacaacctgtggcacaagtgtcatggtagtctgtgctccgatatgtccgcctgactccattccctcggcgattaccgcacttgccccgcctctctccatgagctttgcgagtgctacgcttgcaactacagggattacgatgacgcctgcttctttccacatatccatgtactttgcagggtttcctgcgccggtggtgactacctttaccttttcctcggcgatgatttttgctatctcatcggcctccggattcataagcatgaggttgactccgaacggcttatctgtctccttctttgcagcgactatctgctcctttacccatgaagccggggctccgcctgctccgatgatgccaagtccgcctgcattggacacagcgctggcaagctcatgggttgctacccatgccatgccaccctgaatgaccggatatttgattccaagaagctttgttattcttgtttccatgtcttttaagcctctacacctttgttcttaagatactcaatgatgtcgtttactgttgcgattttctctaaatcctctgaagggatttctactccgtactcctcctcgagtgccattacaagctcgaaaagatctaatgaatctgcctcaagatcctccttgaagtttgactctaatttgatatcatcctcgtcgattcctaactgatctgctacgatttccttgattttctccaacatatttctgttctcctttttctgtgtttattttcggttttgtgtgctggtatatttgcactagtttgcatgtcaaatattttcatcatcaaatcatttgacagtgaaagtatatcacattttaaatagttgtcaagtcaaagtatttttatttttcattttttatatggtacgggagcaggcgggcagaaaattacccatccaaaacgtctcctaccagcagccaagaggctgtaagaattgtaagtcaggttttctatgcctgacgcagccggcttttacgcgccgtccttagcgcggcaacgcctcgcccgtgcttccatgcacgtgcgctgctgtgtacctattacaattccaacagcctctaagcagcttcgtacaaactcattggatgggcaattttctgcccgcctgctcccttacactgtgacaataatatacactaaaaaacagactgtaattatgagtggtcagctcaattttacagtctgctctatattaatctctcaaacacccaaccggcacaacccgaactcctgactccgtggtatatgccatggttgcatttgcgcaaatcacaatcagtgccgatggttctttatatacatcacgtggatgtttttctttttccaatgctttctcattatattttaagataatatccttgaatcgcagcaaggatttttccgcttccggaatcttgttcaccccggtttttatttcaataagcgcataacggccgtcctccaactgatagactgcatctgcttctacgcccatatcatctgtataatgcatcactctggcattgtgcttttcagcaaatacaagtaaatctctaagcaccatattttcaaatacatgcccaaatagatccaaatcgttgataaaatagtccggattaacaccaagcgcagccaatcctatagagggatcaacaaatatatgctttttggcagctctgatagctgttttcgaacgcaaatgcggtgtccaggcatctatatcctttacaacatacaatagctccagagcatctatatatgaagaaagcgttacatctgtaacattctgtgtggcttttacatctgaaaatatattcttgcgttttgctgtagtacccatatttctggcatacgaccaaagcagtgtccttgcccattccggatttctgtttactccatcaatcgctgatatgtccttctgataaatctgcctataataatccttagctatttcaagctttgcactgtcctttgaaagtgccatgcatctcggccatccacctctacagaccgcaaaaaacaaatcctcaagctttatatctgtggtaagtccatcaatatcatatgcttcatcttctaataatttaaacaacgatatgcttccgtttgattctcctgtctcaaacaaagtcatagggtacatcgtaacctctgttattcgtcctgtacctgtatggggtgtattaatcttcttacttgatgagcctgtcagataaaactctcctacactctccggattgtcatcgcacgcttttcttattgttccccatatctttggggcatcctgccactcgtcaaacagtattggcttaggattctttaaaaagagcttaggtgcagtttctgctactgcaagatacccctctctcttgtcttcatcctgaaattcaataacagttttacatcgttctcttgctgttcttgtctttccacatccttttggtcctgtgatgctcactgcattaaatgcctctgtttttctatctatcacatcatcaacaattctgcttatatattccataaatatctgctcccttcatggttattataccatttaattcacagattatacaaggttattttatgtttttcgagtgttttgttttgtatttttctaatgttttattttatatttttcgagtgttttattttacttttttcgaatactaaaaagagcaggacaagtatttctacctattctgctcttttttacatattttaattatttaaatatagattatctaccggctgttcgccatctgcttcacatagtcgagcgccttcttaaccggtgggattgatatcactatgattgtgataatttcctctactgcaaggtatgagccgttgtaggtcactgaatatatgagcgcatctatcatcttgtttcctatcgtgacaggtgcgtatgctgcaaagaacaaaactcccgacagcactgcaaagaaaaatctactgggctgcttcgcctccggtggtaccaccggtagctccacctgtgcctccggttgaaccgctgcctccggctccacctgcacctccggttgaaccactgcctccagctccacctgcacctccggttgaaccactgtctccggctccacctgtgtctccggctgaaccactgtctccagctccacctgtgcctccggctgaaccactgtctccggctccacctgatggattttctgatggtgtagtaggtgttttttcatgatttccaccagcagcatctgtcttattcgtgtctgttgttgtcttatccggtgtggtggttcctgcatcaggtgtggtcacagtctgatctgtaggattattctgcgtctggtcatcggcaggtgtatcctggctgtcctgataatcatccgatatttgggcatatggcaggaaatctattggtgtaaggtcagcatgtatctgatccatgtagttcttccatatttctgccgggtaagagcttcctgtcagttttttgactgtctcaggcatatcgcagcctacccatacacatgtggtgtagtatctggtaaagccacagaaccagccgtccttcttatcgtttgtggttccggttttgccggcgcaaggcatgccattgtccagattagcgctacgtccggttcctgatttcataacatctgtcatgacatctgtcatcatacgcgatgctgtctctgtatatatgacggtgtccttctgtgatgatgtatatatgatattgttgtcagaatccacaatcgacttaatacatgtcggattcctgtacattccatcgttctcaagtgttgaatatgcagatgccatctccagtgtggatacacctgttgtaaaacctccaagtgctgttgctgtgacatagtcatcctttacaatattggtaaaattcatatccttgagatactgtaagcctacctttggtgtgagctcatcatatagctgccatgctacagtattcagtgacttttgaacggcaaacctgatagtcacatcaccgtaatatgaatcacccgagttagacggtcctccatcaaacttgtggtcatttacgatggtatccggtgtcttaccacgctcaaatgatggtgtatacacaatgagcggcttgattgagcttcccggctgacgatggctttggaaagcacggtttagcgtatgactgaccgcatcctggcttcgtccaccaactattgcaaccacctcgcctgtgtcgttgtctatacaggttgcagcactctgcagcttaaatgttccatcatcggtcgtgtctgtaaagtccaaaagcgtcaggtcaattgaatcctgaagctgctgctgcatagtcagatcaattgatgtataaatcttataaccgtctgagtagagctttttctgacaatatgaatacatctcatcatatgaagcatcatactccttttcttcatcgtctgagtcaaagtaatacttgaacttgaagccctcattctccatgagcgccctcgtagcgcagtaatatgcataggtatccacataattgtacttgaccgtgtcatccttctcaggcatgttgagggttatctcctcgtttatggcggcctcatattcctgctgtgtgattttgccatcttcccttagatttttcaatatgagattgcgacgtgtcaatgtatgatccttgttgtttatcgggtcatagtatgtcgggctgttcggaatcgcacacaaaaaggcagtctgcgacaaatcaagatccgaaagctcacagttaaaatagccatggcacgctgcctgaataccataatatccgttcatgaaatagacattattcaggtagaactccataatatcgttcttggaatatttcttttcaagcgccatcgctatgaacatttccttgacttttcgctgccagttcttgttcgtatccagataaatatttcgggcgagctgcatcgtgatggtactgccaccctgggtaattctcttgttttttataattgactttgcggcacgcactattgcctttaggtccacaccattgtgcttatagaacttcttgtcctcgatactgaccatgcagtttacgaagttctgcggtatatcctcatacttcacatagtcagcctttttggtagtggccgtctctgatatctcatcaccgtttgtatcgtagagtgtactcgtgcgcgccggtaaaaatgtgtttttgtcagatttctgcacgagctctactgcctctgagtgaagcttcgccaccttgtctgcatagcctccaaagtaataaaagcataatccaccaagtatcagtaccatcagaaaaatctgaagctttatgaaaaaccagaaaacgcgatgctgctttttcttctttttctttttctgttttgccatttctaaacgttacctccaaactatcggtataccattgtatatcggcatactttatagataattgacaactatatccaatatgtactgtctattatactacaatgcctctacatcagataattaataattgcttaattttctattatacctttatagcacaaaaggaagctaattgctccctttatcaagctattttacatctttattactgttgtagtcaagtaaatagttttttacaatgctttttgctatctctagccaagctggtcagccagaaattctgctgctgcacccgccagcttttcggcaatctcagacttatcggctttttcatcgtaaacacacagtataacggctcccgcgctatcaccatcatgcactattactgctattgcctgcgcttcacagtcagctttatcgtcctttaccacaggtatcagggtatcgtcttttttactgtacaatgcactttttctcttatccataatattctcgagctcttttgacaaagccttgcctatataatttttgtggtttttgccggctgccgctattatctcatccctatccgccacacataccatggctcctgttacctttgacaggctctgggcatatgcctgtgatatattcttcaggcttcccacctgcgaatacttctttagcactatcgtctcgtccgcatccatatatatttccagtgggcttccctcttttatatgcagcatcctgcgaagctcctttggtatgactattctgccgagggaatctactcttctggtcaatcctgtgattttcactttattgtcctccggttacttttttgcatttgcattcatgctttggaggtagtatatgggaatttgaataaaatatacattcgatatgcactgatacagtgctctttcataatagcttttataatgtcacggtatgttttgaatttgataaggtatctatatccgtcagctcacgctcatctgcgatatccacatatacacagtcatacttctttgccacacttctgccacccttatccccctccagtgataaaagctgcgggataagcgatgaatgaaatacacacggattacctacggtatctccacagcgaagtgaaaaaactgatttcatatttcctttattttcaagcactttatctattaatttaatcacgctttgactttttaaatatggctggtcagctactgcaaacatgtagtagtcctgcataccagtctttttctgctcctgcaccgccataattcctgcttttatggtgtaggatatgcctttttcgctgtccggacttaagactgcatggcaatcggggatagatgagcagtagtccagtatttcccgataacgtgtaacgacggttatatctatgaccgggttattcgattctgcattttttaatttattatatctatctttaatttctatcaaacgttcaagcagatgcctgtacataggttttccatccagctcataaaacagcttgttacttccaaaacggcggctgtttccagccgccatgtatatgatatgaatcatttcactcttaggtccttttcgtgccagtcagggtctgccattcccataagtattttctccggggtaaacggaactgtcctgtgccatacgcctgttgcgcgataaatggcatgtgccagcgcaggagccggtgtattgataactatctcgccgattgacttgactccaaatgggcctgaaggctcatagcttgtctcaaattcgacgttgatatgtcccacatcctgtcgtgtcggtatcttgtactgcatgaaatcattttctgcgattttaccaccggcattgtaggtgacattctcataaagtgccatgccgattccctgacctatgccaccctctgtctgtacacgcgcaaggtttggattgaccgggattccacagtccacgacagcctgataatcaagtattttaactgctcctgtctccttatcaagctctatctcgaccatgcctaccatgtatggtggcggtgagacaggtgatgaatatgtggcggtgacatctacaggtatcgtgttgttgacctgtgattttgttgctatatcggaaagacttacggaaactgccccattgtctgcaccgtccggatttatgatatacacctctttaccatcgaaatccacctctgatgcagcacagcccagcagctgtgcaccgattttctttatattttcacgaagctcaagtgctgcattctgtgtggccattcctgtgatgtaggtggttgatgaggcatatgaacccgagtcataaggagaagcatctgtatccgctccaaacactgttatatcatccggctcgcagtcaagtacctcagccgccatctgcgcaagtattgtatcacagcctgttcccatgtctgccgcacctatcatcatattataggtgccacagtctgaaagctttaatgtacacgagccgacatctacattggatatgcaggagccctgcattgcaagtgccatgcctgccgcacgaaccttgccatttcccatgtcgcggacaggatacttttctgcccaatggaaattgtccgcacagtgcattatgcatctgtcgagtgcacatgcattggctgtctcgccaaaatatgccggcataaacatgccctcgcgtacaatatttttcaaacgaagttcaaccgggtctatatgcagcttttctgcgagctcattgaccgttgattcaagtgcaaatataccctgtgtggctccatagcctctatatgctcctgccgcctgcacgtttgtatacacaacatcacatgaaaatctggttgcctcgcagcctcctgtataaagcggaagcgatttatgaccggaaagtcctactgttgtagtactatgctctccgtatgctccaccatttgacagcgtataaagatctatcgcccttatatgaccatctttcatcgctccgagacgcacggtgacttccatctcatgacgcggtgacgcgatagtctgacactcttttctgctgtagattatcttgctcggacgctttgtcctccaggtaacaaatgccggatacacctcacagaccgctgtctgcttggcaccaaagcctcctccgatacgcggcttttcagcgcgcaccatagactttggaatatcgagtgcatttgccagtattcggcgcaggtggaaaactatctgtgtcgagctgatacagtaaagtctgccatatctgtctatctcacagtatgccctgcaggtctccatatatgcctgctgcgctgcctttatgcgatatgtgtgctcaattatctcatcacactctgacagaattttctccacgtttccatgctcatcctcctcgtggtgaatgagattgcgctttacatcgcctgtatctatgctggatgaccagtcatcctcaggatgcacgagcaccttgttatccagcgactttctgaagtcaagcaccggctcaagcaccgtgtactttacttttatcatgttaagagccttgtccaccgccttttcagattctccgaccactatagcgacggcgtcacctacgcttctcacatggcgatcaaggattaatctgtcatatggtgacggctccggaaaagtctggcctgcgatagaaaaacgctttttcggaacatcctcccaggtgtatactgcgaccatgccaggcaccttaagagcgatatctgtctttacatcctcgacaattgcatttgcatacgggcttctaagaagctttatgacaagcgcatcacgcggtgtgatatcatcggtaaataccggctttccgagtaaaagctggctcgaatcctttttaggtatacattttccaaccgcgtggtaatcccttctggcgcggttgaagctgttttcgttagtttgatttgtgctcatccttccactcctttccgatatcctctccgtagacgcctgcctcaagattaagaggtgcgccctccttcttactgtttaagaaatttctgattgagcgcagttgactctgatatcctgtacaacggcacagatttcctgaaagatattcaagaatttcctcatcagtcgggtcaggattttctctcagaagcgccacaatatttacaatataacccggattacagaagccgcactgatccgctccctgtgcagcaaaaaatcctgtaaactgcttagcttcctcctcaagtccctcgagggtgtccaccgctctgccgtctgccctgcctatcggcgtgctgcatgacagcacaggctttccatccagaagcactgtacaaagaccgcagttgcctgactcacagcctctcttcaccgaaaagcaattgtgcttgcggcaaaagtctaaaaggaccatatcctggtctaccgagtcggttattaactttccatttaattttattttaacatccatatatatgaattccttcctacttaatgctcgtgcttaatttcatcgcagatgtcaagcgactgtgtgacagcgcggcgtgtaagcaccctgcagattctctctctgtactcagcccctgcccttatattgcttccaaaacggatatgctctgcaacatattcagcaaatttatctatttttgcattggtttcggagttatctttcaaagctgcattaccgtctgtctttgcatctgctaaacaatcgagtatgccctcctcatcccacacaggctctgccatatatggtgatgctccgatgaccgcaacatacctgccgcttctatttgccactgcacatgtgagcaccggaaagtctgttgactgatttctctggcttaagtatactacgccctttgcatttttcggtactattactgacacaagcacatcgcgcgttgttcttggaagtgccgcaaactcgtccaaatccataattcctgccttgtgaagctgcacctttgctcccagtgccctgaaaatcgtcatgacatctgaaaatccgaatctgccccagatgcttcctccgacagttgccacatttctaaactgcactccgacgatgtgtctgaccgactctgcgattgcgccgtgtgtatatgcattcaatgcttcatgagtctctatctgcctgagtgttgcatatgcaccgattctaaactcgttctcatcctcatcaatttggtcaagcccgaggtcgcacaggtcaattgccgtgccaagcgtcttatttttcattttgagccagagcatgccgcccagcacaaaattcggttttttctgataaagctcataggcttcatcaaggctttgcgccctcacatactgattgtaataaaacatatttttctcctgttatcctgttatataggtaactatccgttacctcatttcgatttcatacatcgcttcccacttgatgtcatgctccttcataaaggctatgaggcactccctgtcagaaagctctgctctccatgccagcccgcagcccgccgatatgacagacggaagaggaattgtgcgccccggaataccacatgccttgcccttgatatcaagctttaatggtgctgtggtagtctcgaatgtgatgattagccgttttttcttttctcttgccaaatttttatccattacctcacaccttgtataactctacggacttacaataagagatgccccagccatcttttctgcaatatcatacatgttggtcacctctccgactgcaagcttatctgacagctcatagtagttcaggcatgttccgcaggtaaggattttcaccccacggctcttaagctcctttaaatcctcaagtgactctgagccctcacaggtcagcttcgctcctccattgtagaaaagcatggtttcaggcgggttatcctgctgcgaaagcgcatagatgaagccctttataagtaccttgccaagctcctcgctaccctctcccatatatgaagagcggattacaacaaccctgttatctgcagccggcctgcatgcatactgtgaagcctcgtctgtatccgaaagctcatcggcatttacagcttcaattgtcagctttacgctgtagcttccgtcgtcgagcttactgctatcacagctatagcccttctgtgcagccatcttttttaaattttccactgcaacttcattgtccacaagtgtctccaccgtatccggctgtgtgagagcctctatcgccttctttgtctttacaaccgggatcggacatgtatcccctattgcatttactgttatcacatttatcgtcctccctatattattttaactcgattattttaactcgtcagccctcaaaagccgggcatgcagcctgtcagcaaatttgcataagctatggcagcttaaaatcagttcacatatatcggcacatcgcgacgcttaacaaatcgtcccacctttgcagccgggagccctgcggctttaagctcatgcaaaaatgcatctgcctcagtagcttttactgcaaacagcagtcctccggaggtctgcggatcgaaaagtacctcctccattgaaaaaggtatattttttgcaaagcacaccttatcacctacatggtttctgttgcgctgggccgctgccgtgaggaaaaactcatctgcgcatcgcagtgctccggtaatgaccgggatggaaatcgagtcgataagtgctgttatatcatcatttaacatctcactcagatgccctaaaaagctaaatcccgtgacatccgtgcatgcatgtatatcgaaagcatgactgatttcggatgctgccttattcagtgtggtcatagagcttaccgcatcctcaattgcacctaacggagcttccccgacgcggtttgcgttgcatacaagccccactccgagtttctttgtaagtataagcacatctgacggctgccctgtattgttgctgtaaatatgctccgggtggaccgtacccatgactgaaagtccgtattttacatcactgtctgctatagaatggccgcccgcaagtgtgccgcctgcctctatcaccttatcggcaccgccctgcattattttgccaagtatattcagatccattttctcagggaaacagacgatgttcaatgcggtctttactgtgccgcccatcgcatagatatcactgagcgcatttgcagccgctatctgtccaaacgtatacggatcatcaaccatcggcggaaaaaaatcaagcgtctggactaccgccgtgtcatctgaaattttgtacactgccgcatcatcacagctatcatatccgatgagcagattgctgtctttttcaccccttggcagctttgctaaaacatgacttaacaaatccggaccaagctttgcggtacagccaccgcccttgcaaaacactatttcctgtggcatttttgctcctttcaattgtttaatactatttatcgcattcccgcaatctgcataagcgcttcagcggcctcatttatctcatcaactgtattataatatgaaaatgagaatctcaccataccctgattttgtgttccaaagaatttatgcatcagcggtgcgcagtgtataccgctccttgttgctatgccatactcattcataagtatgtctgacacctccgccgagtccatatcagctatatttactgaaacaatcgcacagtgcagacccttgtcgggcagcatatcgaaatctccatatatcctgattccggggattgtctttattttttcaataaatgcctgcatcagctcatgctctttagcgtatatattgtcgaggccgattttctcaagctccatgacaccagttaaaagccctgcaattcccggaccgtttaaggtaccagcctcaagtcttgtcggaagctccataggctggttctcaagaaagcttagcacgccggtgccaccgctcttaaacggctttatatctgctctctctcccacataaagtcctccggtgccctgcggtcccatcaaccccttatggcctgtgaagcagagcacatcaatattcatgtcttttacatttatcggaagtacaccggctgtctgcgatgcatcgactataaataaaaggttatgctttcgtgcgatttgccctatcgacttaatatccaccacgttgcctgtgagatttgaagcatgtgtgcagacgatggcttttgtatccggacggattaaagcctctatgtccgatggggaaattatccccctttttatgcctgcatcactgcatggtacaatatccacacccacgccccgctccctttgcatataaagaggtctgagcacagaattatgctcgagctgtgttgtaatcacatgctcccccggctcaaacagtccgtggattgcaatgtttagtgcctcagtggcatttgccgtaaaaacgagtctggccgcatcatctcctccgaaaaattctgtaagacacattctggcctcatatattttcctcgacgcatcaagcgacgcatccgatgccccgcgcccggaattgccgcagtgcttcattgcatcaagtactgcatcatataccacatccggctttttaattgttgtggcagcattgtccaggtaaatcatagtatgtcctcatttacttctcatccaagcagataaaaattctttatataaagctcatcatttatatttttgctaagcatatttgcttctgtatgcctcggaaggcttgcgtaaattattgaatcgttatttaatttgcacaatacttccaagcttttcaactcttcaatcattttataatctttaatcctgattatatttttattattatatacaagtgccgtttttgctttgcctaccgatattattatatcctgtgggaaaacacctatgtgtgatatgtcgtccatatccattgcagtctgttcaagctgctcatcagtgacctcaaatacgctatcccattccacggcaagcacatgatgcttatcctgccatttcacctctgatatattgttacaacccacaagcagtgcctgctccacagacataggccgcatgaagaaatcttttttgtcgcggactgtactcagcacaccgctttccatgcttccgatacgctcggccaggcgatacacttcatcgcgattgtgtgacacaaaaacaacaggattgtgaaaatctgtgagcatctccataagctctgattccatgcttctttttacatgctcatccagtgccgaaaaaggctcatcgagcagtatgcactccggcttagccgcaagcatgcgaagcattgccacgcgctgcctctgaccaccggagagatggttgggatatgtgtatgccatgccctcaagcccatacctcttgagccagccattcactttttcctcgttacgctgacccattgctatgcatatattttccatcacagtcattgtcggaaataatgcatagtcctgaaacagatagcctaccctgcgcttacccgggtgcagatttatacgctttttcgaatcatacagcacacggccgtttaatgatataaagcctgagtccggtgtctctatccctgctatgcactttaatgtcatactctttcctgagcccgacataccgattacggacacaacctcgtccataagctccatgtcaaccgagagcatgaaattatccaactgtttttttatttttactatgagcgacattattttttctctttctctttatgcccttgtttttgccacatatcatatttatcgatacaagacatgcaaatgaaatcgctatgattactatgcaccagaagcccgctgtggcataatcaccgctttggacgaccattgctatctgctgtgatatggtcgaggtttttcctgctatatttccggcaagcatcgatgtggcaccgtactcaccgatagctctggcaaaagccagtgtgacacccgaaatgatgccgggctttgccatcggcagacgtatcttccagaaaatcttccactcacttatgccgagagtacgcgccgcatatatgacattttcatctatctgctcaaatgccgctctcgcatttctgtacatgagagggagtgcaatgatggttgctgccaccacacagccaagccacgtgtgtactacctgtatccccatgctatggcttaaaaagcttccaaaaggacgccttgtgctgaaaatccttaaaagaatgtatccagccacggtaggcggcagtaccataggaagtgtcagcagtccatcccagaatgccctcactctgccctttgtgtttatgacaagctcagcaaaagctattcctatgaaaaaagaaaaaactgacgctactattcctgtttttaatgttacccaaagcggtgaaaaatcaatctgtcccattatttatttaccgaaaaatgatatttctcaaatactgacattgcctcatctgtctgaaggtatgcgataaattcctttgctgcttcaagctcatctgatgtggtggtgtctccctttaaggctgctatcggatagatgacatcgcctgttaagctgtttggaagcttttctataatatcaagctggttctcgtatccgaatgtatctgagtaataaactgttcctatctcatttgcgccctcagctacggcagatgcaaccgcaccaacattggcacagctgtttatttccagaccttcaagtgcctttgagatatcagaatctgaaatagcctgtggctttgaagcatcaccttcaaccatttttgaatttactaacgctgctctggtgtactgtcctacaggaacagttccgtcagcaagcgccatatttttagcctttgagatgtctgcaaagccggtaactgccgtgccactattcttatatgtaacaaggcacacctgattatttaacaggtcaacacgagtaccgtccaccacgcttcctccgtcgtagccattctgaagctcatccatctgtgccactcctgctgagaaaaagatgttgcacttcgcaccctctttaatctgtgccatcagagttccggagctgtcatagttgttttggaagtttacatttggatgcgccctggtgtaggctgcacaaatttcatccataacaccgtttaagctctttgccgcaaaaattgataaatcgacatctgcatctggtgtatccttttttccacagcccgcaaaaagtcctgctataaggataagtccaaacgcaagtcctgcatatgctgcaaattttctctttaagcccttgcactcctttactgatccgtcagtacctgttgctattcttaagctcatacttttaacctctcttttcctttatttaaattaaatatgcatgtgattaatgttcatattcagcttatcttgatttattaatatatgataatttcatcatccaatctgctccagcagcaccgaaatactgcctccgcacaccatgccctctttctcggcatcgtcagtgttcatgctcacatccatcaaggcgcatttgaactcctgcttgcgaaacaatctcctgcaatggcttataacctctgcctccgcacaaccgccgcctatagttccgatgatccgattgtctgagctcacgagcatctgtgttccgactccgcgcggtgcactgccattcttttttatgatggtacacagtatatacttctcatctgatgcctcaataagtgcattaagcacttcgttatccacctgtgtgcagccggtacgctcatttttgcactttactatctcacttatcaccgaaagcgcaatttcctccggtgtctgtccacctattgcaaggcctatcggagaatgtaatccggatatggtttcctgtgaaaatcccgcttcttcaaggtctttttttactatggcagctcttttctttgagcccatcatccccacataggcgtatggttttctgaatatctctgtaagacactccatatcaaagcgatggcctcttgtcatgcatacatagtaatcatctgcctgtggctccagcctggcgagagtttttttataatcgccgcaaattacatggtctgctccttggcgctttgcattatcggcaaacagaggtctgtcctctatcacccatatgtcaaaggccaaaagcgatgccatgcgtacaagtgccgccgatacatgacctcctccgcagattatgaggcgtggtctgctgcctatctgctgtttaaacatcacaatggaattatcattgtcatttatttcatctgcccatgcactgcctgatgccactcttattctgccatctatataaagcgccttttcaccggcatgtgctccttctatgactgtcaacagctcacaacggctgtccgccggtctgtcctttatcgaagcatatatgtttgccggaatcagcttcacctcgtccccggtatgaatctgaccgcctcttatgactactgcaaacacgccctcctttggcataatgcactcgcccatcctcttgtagatagcacaatgcgaatgacactgcttgcctatctgcgtcatctccagaatagcatctcctatgcaaaagcgtgttccaagcggtaaattcttgaaatcaaatcctgatataattaaattttcgccaaatgcgccgttgtctatctgcgctcctcttgccctgaaggcatctattttctctgcggaaagcaggctgacctgcctgtgccactttccggcatgtgcatctcccatgatgccatagtctgcaacaagctccgcctgtggcacctctctcttttcagttcctctctctttgcttatattgattgcaagaagctttcccatgatttgctatcagcctcctatccggctcatatttcttgctgcatttacttccgcagctttcagctctgtagcctttgtctctacagtctttgtctctgtagtttttgtatatgtcactgcattatcattaaaattgtgacaccccggctttgcctttatggcagcctttagtgcctgaactattacaaaatctttttccaaatcatctgtaaattcgcatgaatcaggtactaaatccatcgtcacgctgcttcccaggcatggcataagcctgccgtcagccgtaacacgtatgcggttacaggtatcgcagaacttcccatggattgcctgaatcagccctactctgatattaagtccatgaaaactgtaatactctgccggaccgttatctgaattattatatcccgaattaatttcttctctattttcagtatctatatggcaaggagttccatatacttctaaaagtgcgccaataaccttctcatacggctcgactccgttggtatgcccttcacctaccggcatcatctctataaaacggatatctgtgccttttttggaagcataccgtgtgagagccaccacatctgtctgcggtgtgagcaccacattgattttcactcttattccacactctatggcagcatcgattccatgctctactttatgaagcagcggtttttttgtgatatgttcatattctgacgcatctatcgtgtccaggctcacatttatactgtctatgccggcttccttaagctgctttgcatgctgcgcaagcaatactgcgtttgtggtgagtgatacactcctgacaccgggtatctttttgatttgtgaaaccatctcatcaatctgcggatgcagaagcggctcaccgcctgtcagacgaaaatgcgtgattccaatccttgtggctgcgcggactatacaaagcaccttttttacgctaagtatatttattgcctgacaatttttattattgtcctgtgggttgcaataataacagttcagattacagctatctatcaccgatatgcgcatgtagtcaatctctctgccaaatctatcgcgcatattaaaagcccttcccgaaaccgcagttaggaaacgtacagacatcacaattcaggcagagtccgccttctccaagtccggcaagctcatctgccaaaatcatatcacacgccataagcctcggcaatacaatatcaaatatcgtacgcttgttgtacatggcgcagccgggcagtccacatatcggcaccagcctgtcacctgcatcatagtacgacagcaaaaacatggctcccggcagcaccggtgaaccgtacgacacgatcctcgcgcctgtattttttatggcaagcggtgttttatcatcaggatccacactcattccgcctgtgcagaatacaatctccgctcctgcctctattgcacgtaagcagccgtctgttattttttggtcatcatcatcaaacacctcatgaaacatcatctgtgcaccaaactctgctatttttttctcgatgacaggggtaaacgcatcctgtatcctgccgtggaacacttcatttccggttgtgattattgctgcttttctgaccacaaacggctttatatcaagaatcggtccgtcatcgcatatgtgcgaagccgcctccagcttatccttttttatgacaagcggtatgattcttgttccggcaagcttatccccctttttcacagtggtattgccgtgccttgttgctatcatcatttcaccaaaggagttgacctttttcagcttttcgctgtccaccttaagcagtccgtcacagtcagcaatcacctctatcttgccttcctttacaggggatggatgcattttacttgcggtgccaccaaaagcgccggattctgcggcttcacaatgaccttctgcgtctgcctcattgctatttgtgccacatgcgctcatacgataaagcacctctgctgcctcattttcgtgcatcatggtctcatcattttcccatatatatatggtgtcttttccgacgctaagcagcaccggtatatcctcttttgttataatatgccccttgcgaaaaaccgcatcctttttcactccggggataatctgtgtgatatcgtggcagagcacctgtccgactgcctccgttgtcttcataagcttcatataatcccacactccaaatattatttttgtaaatagttactgtcctaaaccataccccgtgcatttctgtcaccggccgcactcactgtcatactgcagtaaaatatcaagtccatgctctatatttcccatcagaaaatccatgctctccgacactgccttcacactgccgggcagattgactatcagtgtgtttttcctgataactgaagctcctctgccaagcatggctttaggtgtaagactcatgctgtacgctctcagtgcctcagcgatgcccggtgcattacgctctgcaatatccattgtagcttccggtgtgatatctctcggtgaaaaaccggtgccgccggttgtaagcaccagattgcatttcacatcatcacacagcctgacaagctcgtctgcaatctgttccctctcatccggtatgattttatatgaaaccacatcatacttatctttgggaagcagttcctttattttaggaccgcttttatcctctctctggcccgctgcgcctttatcgcttatcgttataatccctacagtatacattacatctccctgttatccttgattaattgtgtatttttaacttctcagcattttaaatgggctataatcgttgccggttacattgttagttgtgatcagtaacgtaatgtccgctcttgccaccggatttttccagcagatgtatctgcccgatttccatgccacggtccagtgccttacacatatcatatatggtaagaagcgccacactgacccctgtcatggcctccatctctacaccggttttgcccacacaggctgtcgtgcagattgccttgatactgctgtttttttcatccagctcaaactcaacatcacacttcgtcatggcaatagcatgacagagcggaatgagcatggaattgttctttgcgcccatgattcccgcaatcctcgccactgccagcacatcgccctttttagctgttcccgtagataccgccctatatacggcgccatttacctttattgtgccacaggctttcgccacgcggtatgtgtcatcctttgcatgcacatccaccatgtgagcttcccctgcctcattaaaatgtgtgagctttcctttattttgttcctgattattgatatcaaatccgttttcctgcgtcaatctatttatcctcactgtaactattcagaaccactgaaaacaccttaatagttacccttatttattatttaataaatctttacgccgtgctcaaatgccgataccgcctcaagcacactgcctgctatacttcttgccttgtcagagattgtaaagcagtttgttagctcactctcgcgcgggtcgatatccgctatcttgaagccttccctgaaataatatccctcacggataaggcctcgtatgatgcctgtaattgtagcattcacagggacatattcagacaatgcattgtcatagctttctttatccggatatatccgcgctatctcatctcccttttgcacgatgtctccgatttttctgacatcatgaatatatcctgccgccggagcatgaatcacacgctcacttgtgaagccggcgatatttcccggaacccctgtgttgggctgtgccatgccatcggtaatgatgcgcgccagattgtgcccacgcatggactcaatcaccagatgcacgtcatgccctgccgtaaagcccgggcctactcctatcacaagcggggccatattgattgtggtacccagatttttctttgctattatggcatctaccacaacatccggcttcaaaagttcaattgactcaccctttgggtctataagaagcgggatctctccggcttcaagcacagcttcgatggctgaactatcccacttttctgatgcaatatgagccgccggtgtgtcatttttccctgaatatgtctctgtatcagtctctgcatcagccaaggcaggaactagtctggctgtcacaccctctacaactgcgctcccatcatacactgcttcacaaaaggacacctggcgccgtatggcagccggatagtctgtctcaagcgctatcaccctatgtcctgcccggtgcagtctgtggatgatgccggtcgcaaggtctcctgcaccgcggcatatgattaacaaatttttctttattatctgattattgctctgattcatgctcatctgattaattaccctgttaccttattatttccatatttgcaactattcagaaccacccacgctcattcgcaaaaacgcacgatactcgtccttcaaaaccgctatcgcgcagctttctgacatagacctgccgcagcgtatctataatcgaatcatcaaccactgcatccgctgccgttccaagctcctcttgcataagctcatatcgaaatacaacgtccttacatgacctgcccttttcccatgtgccaagcactatgataacatctgtggtacccggatatatgaccggctcatccgctgccggatatttgagggaatggtgctttgctccatctgcttcgattataacataatctaacgcctgtggcatgtctttaatcagtttatcgagcaaatcatacggcagtccgcacatctttggctttgactgttctgatattttctgttcagatattttctgccccgccatacaatatccatcttttattattttatcccttaacgcaaaaaaatcgcaggataggtcagtgtcagcttcgacatacatgtgcgttgtcgttgtgacaagcacaccttttccactcctgtgatattcccttgcaagcttatgaacgagtgtggtcttgccacctgcgcccactattgaaatcactttttccatatatttccatactttcccacaaacaataaagccgccggtgtacttaatgcacctgacggcttcaaaatcctaagcgttagtcatccacacgcttcacatcgtctttctcgtccatatcccacatatatggcgcgttctttgacttcttcggcaaaataatattgagaagaatagcgcaaagtgagcaaggcacgatacctgaaccgccaaatataagctgtacatagtatggcagatgtgatgtagcaccggttgtagcgccaagtccgtagcctaaaccgattgctactgagataattgtaatctcacggctgccgattggctcctttgtgatgagctcaattcccgaaatcaggatagaggcaaacatcataacagcagctccgccgagcactgactgaggcatgattgacatgagagctccaatctttgggcagaagccgcaaataacgaggaatatagctcccattgaaatagcaaatctattgacaacctttgtcattgaaacaagacctacattctgtgagaatgaggtatttggcagtactccgaaaagcgctgcaaatgatgaaccaagaccatcacagataacaccgcctgaaagctctgaatctgtagcctctctgtccattccaccctccacacaggctgagatatcgccaactgtctcgattgcagtaacgataaacatgatgccgattgggatgattgcattggcatggaaggaaattcccacatctgacagctttccaaagcctataaagcttggaactgctatccatgccgcatttttaacctcatcaaagtttacaacccatgagtatgtgtatttaacaccgtcagcggtcacacctgtgtgtgacatggtaagtgtcataatgattgctacaacatatcctgccaggataccaaaaaggatggcagatgatgaaaaaatactgcgcgatggtgcaaaatgcttaagaagcacgattactataagtacaaccattccaataaaaaggtttggcagtgagccgtaatcatttttgcctgttccaccacagaagtagttgattcccactccaaggagtgaaagtccgattgctataacaactgagcctgtaacgattgccgggaaaaacttgcgcaaaggctttaagaaggctccgagtatgccctcgaagatacctcctacaaggcaggctcccataatagctccatatgctataactccgccgccacacgctgcaactgtattatttaatactccaagaaagcccgaagaggttcccataacgataggtacctttccgccgacaggtccgatggaaaacatctgtactaatgttacaatacctgcgataatcattgcattctgtaagagagcagttctaagctccgcaaagccagcatccgctgtgagcccgcatgctcccataacaatgataagaggtgtaaggtttccgatgaacatagccataacatgctgcagtccaagcggaatagcctgagacagaggtattctgccctcaaactggtaaggtgaagagttcgttgtctttttcattggttcctccaaataattatactcttatttaataaaaaatttacaaaattattttacgagcataaggctatgtggtcaatttagtattacttataatataatatctatttacttataaataaatgttattgaaattagtttctgacagcaacagggcacaccacaaccggtatgccctatctattacaaacgatatagctattcagaataatctaaatttattcacccctaagcagctcgcagtttccctgcatatccttccagaaatcctttataggtgtgccgcgaaactgattgactatgctacagttcattgcaccgtgtcccacgacaagcacatttttgcctgcctcaagctgcggtctcagcacctgctctataaactcgcctgttctgtgatatagctcctcaaagctctctgcgccgtcctttgccacatatttttccggctcctcaaagagcaggtagacagggcattcgggcttttgcctgatgttcttcactccctcataatcaccgaagcacatctcgtgaagcctgttgtcagtgataatctctactgcagggtttctgtctgcaagaaaaatccttgccgtctcctgtgctctcttaagcggggagcagtagcatatgtcaaaatctatatccttatatttttctgcggcatcgtaagccatctgcctgccggtttcgttgagtgggatatccacctccccctgcagtctgtgctcctcattccaatctgttcttccatgtcgcaaaatataaaacataattaatcctcgatttctccatttctatgtctctcgaagaaatgctttgtctccttaacaacaacaccactgagagcaaacagcgctatcatatttggcagagccatgagaccgttgaagatatcagcgatagtccacaccgcacttacagtcatataaggtccgatgaaaactgcaagtatatatatccatcgataaacctttacatatttcatccttccgccactcaaatactctaagcaccgctcactataataatcccaaccgagtatagttgtaaaggcaaaaaatacaagacacagcataagtacaaatgctgataactctttcggtaaaggaaggccattctggaatgcgtatgtagtaacctgcacgccctcgagtccgtcaacctgccatgcgcctgtgagcacgatggaaagtcctgtaagtgtacatataactattgtatcaatgaaggttcctgtcatgctgacaagaccctgacgtacaggctcctttgtctgggctgctgccgctgcaatcggggcactaccaagtcctgcctcgtttgaaaagattcctctggcaacacccttttgcattgcaacaagaaagcttcccacggcaccgcctgttatggccttcggtgaaaacgctgcctttactattgtagcaaacgctgccggaaccgctgtgatattgcataccacaagcacgagcacaaatacaatatatataacagccataaaaggaactattatctggctgacacttgcaatacgctttactccgccgataagcactgctgccacgcagaatgccagtacaagcgaagcaatgacaaccgaccatgaatactcaccaaggaacggtaaaacctttactgtatgctggtttttagggtcaaaaaagttgtttacagcacttgatattccgtttacctggctgaatgttcctattccgaatagtccaacgcatacgccgaaaaatgcaaatatctttgcaagccatttccattttgcacccattccctgctctatgtagtagaatggtccgccgagactatgtccgtccttgccgatgacacgatattttacagccaaaagtccctctgaatactttgttgccatgccaaagaaggctgcaagcaccatccagaaaagtgctcccggtcctcctgcaccgactgcagttgctacaccgactatgttgccggttccgattgttgcgctaagcgcggtacagagtgcgccaaagctcgtaatctcgccatcgccgccctcttcatttttgaccatccactttagtgccagaggaagctttctcatctgaagaagccccagacgaactgtgagcattatacctcctgccatgatgagcaccatgagcggcactccccagacgaaatcgtccactgctttaagaaaaatgttgattgtgttccacattgaaatactcctgcctctcttttttatctaaacacaaagtctttgtgttttgagcaaatactattaatataaatgatatgagggtcaaaaggtattttgcccctcatttatgacatccggaaacaattgaaaaagaaggcttagcagcacttacgtgaattgaaataaaaaaccccatatacgctgcatatacagtctgatacatgggattaagaagattatcttaagaatatctgtccaatatcttctccgtcctgttgcctgagagattcgtacgagaagcagcctgtgccatgatatattcatagtcactgcactcctactgcttcctattcgtacgttgcaccttcggcccccgccaagcgggtgtctccagagagtcgatccatttacagttgcaccgcctgctgcggcacctgagagttttactccttcggtaggctttgataaggtaaaatcgctgccgttttcctgcaaacttcatctcgaaattgtttattttaaatttattgtttttattaaccgttaagaattatatgacatatatacgatttaatcaatagtacaaatgtactaaactgtctcaaccttaatcacattggtgttgcctgtcttaccgttaatgagacctcctgtgagcactatatgatcacccttttggagcttcatgacactctttgcctcattcatcgcattgtagaacataacctccattgagttgtattcctcgcacagaaccggctttacaccccagctcaggttcagcttgcgccatgccttttcagaggttgtcatgcctattatatcaacagggcagcggaaacggctgaccatgcgcactgtacgtcctgtcagtgagctgactacgatacatttcgcatccacatctattgccatggcacatgtagcatgtgaaatagcgtcaactatgctttttgtctggaaatctgcattggcaaatctcttgccgtagtttatctgcttttctgtatattctgctgtctctgccatattttttacagcctctacaggatatttacctgctgcagactctcccgaaagcatgatagctgatgagccgtcgtatacagcattggctacatccgaaagctcagctcttgtaggacgcggattgtgaatcatggactcaagcatctctgttgctgtgattacacgtgtaccaagcatacgacacttgttgataagatacttctgtattgccggtacctcaactcccggaatctcaacaccgagatctcctctggctatcatgattccgtttgctatctcacaaatttcctccacatgatctacacctgaacggttctcaatctttgcgatgatttcaatgtcctctccaccgttttcatccaaaaagcttctcagatcagctacatcctgctttgtagaaacaaatgatgcagcaacataatccacctcgttttttataccaaaaagcagatcatccttgtcctgctcgcttaaaaatgcatgcttcatgaccttattcgggaagttcatgctctttctgtctgaaagtgtaccgcctgcgataacatcacagattgcatcgtttcctttaagctctctgacctgcagaatgatgattccgttcgcaacaagtacacggtcaccaacctttaaatccttgatcagattctcatagtttactgatactcgctcctgatttcctacaatatcgtcagtggtaagtgtgaatgtatctccatccttgagctctattttgccattctcaaaggtcttgatacgatactcaggtccctttgtgtcaagcatgattgcgattggcatatgaagcttctgtcttaccttcttgattaaatctattttgccctgatgctcctcatgtgagccatgagaaaagtttaatctggcaacatccatacctgcctttatcatcctggtgaggacatcctcatgttcgctggccggtccaatagtacagataatttttgttttacgcattgatattcctcctgatgctgatcaccctatcagcttttcttttaaaatataatctcacccgaagtcattatatgacaattttcttcaacaataaagtaaaaatatatatttttcaattatttaaaaattcatatgctccacatacatttcattgaaatgcgaatacgatgccagctcgatgtaacgcatgttcccgcctatctccagtgctctttcccaggcttcctgcgataaagcagccgaaacagctccgtttcctgccgcatttcccacttcttttgccttgtccaaaagctcctgtggaaacaatcctattgcagccgcacttgctttgtcaatgtagtttccaaagcctcctgcaaatgtgagaacatcaatattacaaggcgtacagccatattccttaaacaagacttctattccggcggctatcgcgcccttcgcaagctgcagcttcctgatatcctcctgcgtaatgtaaactcccggtgcaatatgaacggcgagagagggctctgtgctctgtgcagcctcctctgcttccacctcaaacacatacgacctaaacagtataggaagctcctgtccgcttaaaatcgtgccgttttcatctatgattccggctttcagaagaacggcaagcgcatcgataagccccgaaccgcacagtcccacaggtctgtcatttccgataaccgaatacttaattctgcgcccttccagccataccttatccacggctcccttagatgccggcatgcccagctcaatctgcgcaccctcaaaagccggccctgccgcggtggcacagcacacatatctgtcgccttttccaagcgccatctcaccgtttgttccgatatccagatatagcgtcagctcgttgcagttcactgtctccatcatacccgctgtaatatctccgcctacaaagcctgatacagccggaaatataatcatggtttgacaattctcaagtcctatatccaaaggattaaatttcctgccaaaatattcatccggcataaatggtgccttgccaagcttttccggtgaaattcccataagcagatggcacataaccgtgtttccggcaactgaaaaccggctgactttagttctgccacattccgtgagcatttctgatatccagccgttaagcagggacactatctgtgtctgcatcatctgcaggccgccattcgctttatcgttatcatccgccctcgctgccgcatcaattctagaaagtacatctgctccaaagctgcgctgtggattggcaccgcttctggttgagataatctgcccggtctctttatcaatcagatagcagactactgttgtggttccgatatcacaggccgccagagtgtcttcatttgattcgactttttcagattcatttgcggtctcttccttcaagacaacattcctattcacatgctcatttacatgctcattaaatttttccgatacatttcctccatttgtcagaacaaccatgctgtcttctttggttccggtgctttcttttctcccaacaataatttccataccgtcacaaatcttcgtctgacaggccagcacatccttatagtatggttttgtcaccgtcaccttgcatttaccgcaagtgccttttccaccgcacggtgtttctatccctgcaatgccgtgactgcggcagtattcaagaatagtggttttgtcggtttttttgctatctgtgttaagatttatagtaattctctgctgcatatagtttacctcatttgacattgtactattatggctttttctttgattgtatgatagcacatttatatacacttttgtagacaaagcacgagtatcgtgcggttttgtgaatgtgagtgggagtgattctgaatagttacctttaatataaagacccggacaaacgcccgggtcttcattgatccatatatactatgccgtattacactatgtctgatctatatcatctaatccatgtcatctagtctatatcatctaatccatgcacatgaattattctatttggtaagtgctgcaacaagctcatccatctgcttttcagatgcctcattgagagtagatttaattgtaacaaccggctcaacacactcaatattcttgaagccctcaacaatagccttcatctggcgtgctgctgtaggagcccatgaaccgttttccacgaatgcaatcttacgattctgatatgcctttgccttgagatgatgtaagaaatcctccattggtgggaaaatgcctccatcgtatgtgcatgcgcagagcacaagcctgtcgtatctgaacgcatcctcaacagcctctgccatatcatccctgcaaaggtctgtaaatgcaacctttacgcctgcagccttgagcttttctgctaaaagctctgctgccttctttgtattaccgtgaatagaagcacttgccacaaggattccctcatcctcaggctgatagctgctccatgtattgtatttatctatgtagaagccaaggttctctgtgagaatcggtccgtgaagaggacaaatcttttcaatgtcaagccctgctgcctttttgagaactgcctgcacctgagcaccatactttccaacaatattgaagtaataacgtcttgcctcacatgtccagtcctcatcagtatcgagcgcaccaaacttaccaaagccgtctgctgagaaaagcaccttgtctgttgactcgtactccatcataacctccggccagtgaaccataggagccatgacgaatgtaagctcatgctttccaagagaaagcttatctccctctgccactacaacctttctgtccgttaagtctatatcgaaaaactgtcccatcatgttaaaggtctttgcattacctacaatctgcatatcaggatatgtctctgcaaccttctggatattggaagcatgatccggctccaaatgggaaacaacgagataatccggctttctgtcgccgagcgcctctctcaaattggcaaaccacttatccgtaactcttgcatctgctgtatccatgattgcaattttgtcatccataatcacatatgagttgtatgaaacaccgtttggaacaacatactggctctcaaataaatcaatgtccttgtcgtccacaccgatgtaaataatgctgtctgtaatcttcttgtccatgataggtacctcctgctaataatctccagttaaattagtaattattactatttttgattagattatatgacaaaagtatcatttggtcaaccgaataaattgtatttttttgtattttttgatattctcgcctaaaggttacactgaaacgctcatccacttttagttgcaaaagtatattttcaacaaatctgttattgctttgtcatttatgacagcccgtcctattgttatgccattgttgatgataatatattctccgttttcatatctgacatttacaaaatcatcttccctttttaagtctatacatatacttgatataattccgcaaatctcctcttgtgagcttccgctttttatctcataagcataatccgcatctcctatctcattcagattagttaccaaacaatactccgctccattcatcagcatttcttcattcaaagtgggtaattgagccgtcttatactcattaaataaaaagataactacaagcgcaatgaatgtcggaaaaaagataccgccaaaccgctgtgcataattttgttcttcccaccgcttgctatgacgaccaaacagcggtattttcatctgcaccaaacctgctcctatacttacaagcaaaaaataaaatataacttttatcaaagactcatccccatttaatcattaataaaaatatcgttcctaaaacgacgcctactaaccatataaagcgaaacaccttgttatatctcgaactattagaacacggaacaagccaatattcctgtggaaaccccaaaaggtattcttttaattcctgcttcaattccatgactatactccacattaatccagacagcacaatgcacaccgttccataatatgtaattggtgcatttgtaaccacagcaaagaaataatgtgccatcttaagaaggaagatacaccacgcaatacagcatggaattgtaaacgcccttttcattttccacttcaaacccaatataacctctggaacgaatacagtcaatgcccccatcggcaatcctcctgttcgtccatgtgtgaaatcgctctccgactccaaagaccaaattcctgtcaatactattactgctggtattagtatggtgcagaacaagttatatgcaataatcaacacattttcattgtcgtcgttcataacttagcccccaatcagttcatcaagcctgatagccactcttcctgacaatgaataatgcaatgctgttagctttgccttatcgtacaaatttgcatacacgttataataacatagcgatattgacataccaaagccaaataatgttgttcctgccaatactcctaaaaatcccgtaacacatgcatcaatatactgttggctgacatcctccggctccaaatctacatacattgcatttaataattcatttacagaagccgtactctcatagtggtccttaaatgaagtgacaattaactttgctcttgatgcggttttttccggatcaaacgtagataaaccatatatcgcatttgcggtatttatggatataactttcccctcatccaccgcagttagaatgtctgacgaattatttaccgcagacttgaactcatccataaaattaaccagatttgtagagaacatagaaaacttactttgtgctataaaattctcatatgctgcaatatcatctgaagtaataacataagcatatatattatcaaatcccggactttctttagtataattaggattgtctatataatgggacatataaagataaagtacatatttgttaaaatctgttgtgttatatgtattaccatatctttctaatgctacttgtgtaacatattgcatcctttcattctgttcttgtggggttgctggcggattaccgtcctgtgcataagattgaatatacccttgctctgctattgctttttctaatgcctttgtttctgctgtttctaatgataatctagctatgtccgtgttcaacgacgcataatatgagtcatctttcctttgcatttgcattatattggcaatatcctccgaatcaaaaccaatattctcccatgactgtcccgctactgttatatcgttcagcactgtcaacatatcatccggattaatccgagccgatgatgctgcatatatcggctgaatagaacttccaacggttgaaataaacatcaaacatattgtaattaccacgctaatgactttcttaatcattttgacccctcctgttctttttactatcactctaattaccatataccaaacatgtatgcccccaaaaataagtattatatagttactggaaaatattcttacttgacagagaaacttaaggtgctggaatagttggcatctttctccaaagctcatttcaatataaaccatgtttttccgcgaccgagttaaattcgcccatactgcaatctttttacaccgattactaaagtgaatccaaaaagcatatcaaaatgtgcctttcaagatactatcgggcaatataaacatgttcaagtcatttcttcaaagcctaaaaataacttcgaatcgcattgatccgaagttataagtatcatatagctatcggaaagcattcttacatttcctgcaattttaatttattttgcctcataagaagaagtaaacctagtccgtccagaatcgacttgattattatacgcatctacaatgtcgctatattccgttgaatcgctaaaaggagcaatatcgcttgtattgtcagatacactcatgttagaaacaggaccggaaattaacaatgacccgtccggctgggcataagcaaaaaagatatattcatttcctacaaccggaagctcatcaccctcataaacaaaatattgtgagccatcttccgaaagtccgccagatttttgaatcgggatagccgtgtcagtaactaaattgcctttgatattttttgtgacgttcacagtataatttgtgtatgggccggaaacttcacgagtctttccatcgtctgtttcaaccgtaacagcatctttataaacagtaccttcttcacttgcgaccgtaccaacgaatacataatcagcatcgcctacaactgcattcagatcgctataatcaatcgaaaaagtacctctcaaatatgatgtcttaatttcgtcagaagttgaaggtttcgcaatgcaaaaaaacagcacaccaataaccagcaaaatcacaacagctccgataaaaataccaattttggttttagactgaaatttcatagatattcctcccttctttaatatcttttataacttgcgtcataggaagccttgtcgttggcagaaagacttgttactgagcttacatacgcatacataacatcgcctttcgcattatgagctaatcctaaggcatgacccaactcatgtgtgcatacattccgtttctgagcagatgtaaaattatccatctgatatgtattgaacttaattgtaccagccgaagaagtaactccagcagttgagcttacctcattgtaatcagaaatggtaacatcgttaatcgtattccaagcgtctttgcgaataacaccggatttataattattccatgtgcttacggcagaattaaattgagtttggtaagatgtactccctttccaatccaaatgtttgccagaatcaaccaagtaccaattcaaaatagcagtagtagcagcagacacaggaataacagaaatagagaaaaacaaacacaaacataggagagccatcttttcatttgacttttcctctctatttactaagattgatagtgccttgtttcaatgttaaataatcggaagttgcgctaataatatataaattgtattctcccccctctctaacttttaattcgtaacttccgcttagacttccaaaactttctccgtcatacataaccccatctttaatatatcctataaccagcacctgattagaaaccacatctgactcatatttttcaaacgaaaaggttaatatatcccctgctttacaattccaacctgcataatcctccagataaaatactgccatacttccgttagtcataataatttcaggcgtcgtatcattctccaccttaaactcagaaacagataatggcagcacaatattatcatctgcaacgctctttataatatggctttcagttataacgttcccagcattattctctgtattactttcttcaccatgcgtaatctccgatttcgaattatctatgacttcttttccgatcaatccttcgttttcatctgtaactaattccgcaccaaacagcccattaatccattgaaccagtttctctcctgtcgctgcattggcaattcctcctgttgtaaaaagaatgatacttaccgccattgcagttgcaacgcgagccaaccatttacggctatgtgcgttactttcatgaaatagtttactattcttttgtaaggaaatatcgttttcttttttttgctctaaacattgtgcagcctctaggatatatttatcgtttatttcattcattgcataaaaaatatctgatttcaaagttttcataaatacttcctttccgctaattgttctctcagcttttttcttgttctaaataagattgtttcgaccttgcttttgctcatattacaacatttcataatctcttttaccgacataaagtaccaatatcttaatacaaaaacttgtcgatgaggtttttgcaacgattccaaaaaatcctcaacaatatctttcaattcattattttcccaatcttcttctcccgctttcgccagataattactcaattcctcatatggcaaacacatatctatatctctttttgccgcatgaatatgttcatacttttttagcgcctgattccttgcaatttttaaaatataagctttcaagttatctggtgtttttgggggaatcgtaaaccagacacctaaatatgtatcatttgtacattcttcaacatctaactgattctttatcagcctgccaattataaatgatacaagtttcccatatttcttctctgtttctagcaatgcatcctcggatcggcaattatatagtttaattatttctctatcgtccattacaaccctcttttatttattaagtacggattcgatcccttttgcttgcaagttttaaaactttttgctttattttttttatttgtcatttcagctacacagaatatagcttttgatgttaacagtgcctaaccctttccatgctggtgttttaataaaaaagccagaggtcagtgtctctggcaaaatgtatattatattaagtttgctaagttcgtccaatttgcatcataacccattatggacatgatatctgtggctgaaatggtatgtaactgtttttgaagtttgccaaaagcagttctcatagatgaaataaagtcctttaagtcggatttgcttagtaatagcgcaaacattatagctatggcgtatgcatcattagttccataagtataggcgccatctttggcacgtacaatccctaaaacggagaaatttttaatactttttgtatgatttatctgccatggtacctcctatatataaaaagcccccgggtccgaaggacaccggaggacaaactggcaatctcttgtataagtattatactacacattggcaaaatgtcaatgacactatgctgatttggtgtggatccaaatttttcaatttcactttattaacctgctattccaaaaacaattcaaacccataacagctctacaaagaaacaaggacattgatatttactatcaacatccttgttctaattattacaccatctcaggaagtttgtagcctaatttttacattgcgtctgcgaagtcatctaatgacatacttactctacttgcgcctacctcaggttctaatataccatcctgaacaagtgaatatatttcaaggcatctgccttgttgtattccttcctgtatgccaagctttttatgatcatcctatgccttacacatatttaccacatcttccttttcatcatacttaatatcagttcttgtctcaatataacctatcacctacaataattgcccataaagcagtatcgatatactcaccatttttataatatttttgtctggcaatgccttctaacaccatgccgcatttctttaataccgcagaggaagcatcatttccatagaatacttctgcctgaactctgttaaatccaactctatcaaaggcataatctaagacagcctccaatacttctgtcataatgcctttattccaaaatccgggagacagcatatagcatgtatcacacatatgacatgcttcttccacatttcccaaattaattgttcctatcaattctcccgtttctttccactcaattacccaatgaaaatatgaatccgactcataattagatatccaatgctttaccttgtccctatatatttctatgtcatcaacaggattaaatggatagtatctgcaaacttcatcatacttagcccaattttcatacatcatagtataatcggatagtttgattcttcgtaaaaagcatcgttttgtttcaaaattctgtgtacctatataattcatcaattattccttttcatattcaaaatcatgcactaatacacatagactgtggcaatagtttaatatccactataatggtttgactgactcaacatattcgtttagcttcgctcttatctcttcaaactgctttcctgtaatctcattatccgactcaaatgccatcattttgtcaagatatcctctctcctttgctatctgaagactgataggataaaccagctcaaatgtcagtgcaatgtgccctgccacatggtctaccgcggtctttttacaggaacgaagtaccgcatgcctctcatcaaaggctgccataacctcaggactcacctgcgaatttttcagttcctccgtcgtcacattatatatatcctctgccggagtatctacatttaccctgaaaatatccaccttatcagcatcccttagtatattgcaaaacataaccgtataatcatcgagcctctcatctattctgaaagcactgtgatttcttatcgcattttcaacaattatgccgtatttatcatcatgaaatccatccacatatgtgtcgataagcccttccttaaacagcaggtcggctccaaaattggcatgatcaacagactgtgcatcgttaaatgtgttatagcgcttaatctgttcaaatcttccgacatcatgcagcatccctgtgagccatgccacatctgtctcatattcatcaagctttaaatcccttgatatcagctcgcaaagctccgctaccctataggtatggtctattttgagcttaatctttgggtctgtggcgttgtaccctgatgtgtattctgcgaatgtgttttttactcgttctctatctattatcatgtttattatcctttcaaaaaaccggtttatctgtggcttcattgctgctgttttaatttccatcgcaccacatcgctatgtggattaactctggcaagtccaatctccgtaattgtcgcttcaaagggcacaaagctttcctgcattactgaaaacgccatctgcatatgttcctttgtcagtgtctttccaagtgtaatatgtggcagccagctcattggcttgtagtatctgctcactgcacattccggaatgcttttcacctcatcaaatactttttccgataaatcctgcaaatatccgttaagcaccggcgtggcataaaatacatatggcagcaattgccccactgacacaatgctaatcgtcccattagaaagtgaatttcgcagattatccattgctcccaataaagcattttcacttcgggcttctattgccgatatcgtcatgtgtggcggcacattgttatccgtcatgaatgaattacctgttttctcggctattttatttatatatcgttgtaaaatatgctctgccgtcttgtcaaaatatacagatacaagatacatctactttcccctgtcatataaaaatcatgccccaacacacataggtcggggcaatttccgttatacttttaagctatcaaactacaccaattcaggaattttgtagcccgctttttgcattgcgtctgcgaagtcatctaatgacatacttactctctttgcgcccacctcgggctctaatataccatcctgaacaagtgaatatacttcaaggcatcttccttgttgcactccttgctgtattccctgttgtattccttgctgcattccttgttgtattccctcctgaatgccacgctttttatgatcatcccatgccttacacatatttaccacctcttccttttcatcatacttaatgtcagttcctacaaatagattgatagctgctactgtctcaacgtcaacccttgtgaaggtttcgtcttttgtaattaaatcattcagcttttcctcatctgacgcatttttcaataactcaaacaatggcctgagccctgtctcgaacttggaaaagtctgtaatctccagtggattcagcaaattaatcctgtaatcgttgatgaacgggagtattctttcatccatctgtggcatcatctctgcaaggcttcttggcccatcccactgtgtagttccaagatacagtgtgattgtaatcaccggtgtcagcttatcatcaagtgtaaagcctgacaaaaactcgtccgaagacctgtaatccttatttttccagtgacatttctttgcctcgttgacctgttctccgtaattcaatgcatcataaatcatagttttaacaggcatcgcataatgaatgtctgtctgcgcttctgctccaattaagataacatacatttgccctgtatgcttcacggaaacactttttagcaaatctctccatttctgcttaacaatctgcttcttatcaataccgaaaactgataacacctctgtggtgtcacattcctttaaatcctccggtttgataaccttctctccgtcaaacaatacataattacagatttcactaaacctcgtattatccgacaaatactcctttgccttcgagtcctttgtacccaaattaacctcctcttcttgtgtgagcaggaaaatctgaagtcgaataaaaatactgtatacttatgctttccacgtatataatgtgtacaataatcccttatataaaagccggcaaaatccccacaacccgcttttctcgcaatgttttcacatctaacatttcaattttcctgctattaactggtaacataaagcattgaaaatttccatgtctttgtcgaaaaatgcgaagtggtctgccctcttcaaagtgatacgcaccgataaaaatatgctgtggtgtcgtatttacagaaatataatgctttgagctaattgtagcacagaggaaaagacttgtcattatatttttccctcttcccggctattcttcaaggtagatgcagctccctctccggcaaaatattccttcaccagctttacaactacacccgaaagcaaaaatactgcgataaggtttggtatgaccataaggccattgaaggtctccgctatgctccacatcagtccgaggttcattgtcgcaccgactatcgcaacaagcgaatatactaccatgaacggcttatttgccttagttcctaataagaactctatgcatctggttccgtaaagtccccagcctatgatggttgaaaatgcaaaacagcacatagcaaccgctgtaaagattgatacccagccgccgtaggtggatgtaaatccactgattgtaagctctgcgccggctgcttctccatagcccacagaaactccgctgcaaagtatgacaagcgctgtgagtgtacatatcacgatagtgtccacaaacacctcaaatatgccaaagaagccctgctttactggctttttggtgtctgcacaggcatgtgcgatagagcctgttccaagacctgcttcgtttgaaaaaattcctctggaaactccctttttcatgctcataaaaaagcttcctactgctccgcctgtcactgctgacggattgaacgcgccctctattatggctccgaatacgcccggtatagctttaaagttgacgattactactccaagtgccagcagaatatacatcactgccataaatggcacaagcttttcagtaacctggcctatacgcttgattcctccaagcagaataagcgcaatgagagcggcaagcactattcctattatgagattgaacgttgatgccgactcttttgaaattatatcgtaattatataaagctgaatcaatcgctgtggttatggtgtttacctgtgtagcgtttcctgtaccgaacacggtgagcacgccaaacgctgagaacagatatgccagccagtgccagtgctttttaagaccgtttttaatatagtacatagggccgcctaccaggtcgccgtttgcatttctctcgtgaaaatgtacagcaagtgtgacctccgagaacttggtgcacatgcccagaagtgctgaaatccacatccagaacaccgcacccggtccgcctatcgcgatggctcccgcaactcctgccacatttcctgtaccgaccgtcgccgcaagtgccgtacacactgcctgaaacggtgtgagcgctccgtcggatgcctcacgttttttgagcatcctgccaagcgtaaccttcatcgcatatggaaactttctaatctgaataaatcccgttctgaagctcaaaagcagcccgacacctatgatacatatcatcgcaggcacgccccagataaaattgttgaccacgtcattgactttttctattactgataacatctttttctcctactgaatttagtgtaacgtataaagtataacacggtttgtacaattttttatatatttaatttcatttttttgaagtttttctttataaaaaacacccggatatagcaatttatctatatccgagtgtttatttttgtataatatatacaggatatccctctacagtccctgtgtcatcttgtaatctataagtgtcatgagtgattctgactcgatggcgagctgctcacactcctcaatccacttgtcataggcttcactcgcctcatcctccggctcctttgcttcgagcgcctccatcatggcattgacctcggcaaattctgccttgatatcctctaagagagagtcttttgttgatttcatagtatcctcccaattgatttaacgtaaaatatatttttatgttctcatgatagctcgaatagagccaccgccacacaatttcacaaaaatttcattctacaaagtgtggctcaagcatctcaagctccgccacatctatgcagtttggaatcgtgccgtttatcacgtcctgcttacactctgcgtagtcaaaccactttacagagtcgatttcctccttctgcacggtgatgtccgcttcgtccacatcgagccacagaagaaacaccttgcttatctggttgtccaggaatctttctccgtgaaacacctcgtctgcatggtgtctgtgcagtccacagtcgataagctgtgccggatctattgtcaggctcagctcctccctaagctctctgagtgcagacggtatatagtccacaccggccggtatgtgtcccgcacttgatatgtcataacagcccggaaaggagtctttttccatgcaccttttctgcaaaagtatctgtatggaatttccacggtgtctgactatccagacatgcgcagtcctatgaagtatattgtttctgtgcgcctgcttgcgctctacggtctgtcctgttggatttccctgctcgtccactatatcaaaatattccatatgagactcctttccctgctcaataaagtgcattttttgagatatattatagcttatttctgatcgaagtacctatcccggaaatcaaggatttccgggatggttcggcggtcgccgaacttgaatttagccagacataaaatcatgcaagcacgattttacgtctgccttaaattcagtacttctcgtcgcttacgtcctattcaataggtgctcctgccggcattggtttctccggtgtcaggagtgcgagattgccctctgcatcctctgcgcacagcagcattccctctgataaaacacctgcgagcttagccggttttaagtttacgagaaccattaccttcttgcctaccatctcctcaggagaatagtactttctgatgcctgatactatctgctttgtctggtttccaatctttacctgtgagcagagaagcttctttgacttcgcaactgcctcacattttacgatttcaccaacctggaactgaagcttttcgaaatcatcaaatgtgatttcttcctttgcttccacatccataggctcaaggtctgcaccatctgcggcattttcacctgcaccacagccacatgctgccttaccctcaactgcagcaagcttagcctgctcagcctcaaactctgctttctgtaccgcctggattttctctacctcaggcatcacatcctctgcctttaatctgccgaagaggatctcaggtttgtctgtaacctttgtgccgctctcataaagaccaaatttgtcaagatcatcgaactcacggagtgttgtgttaagctgtgccacaatcttttctgctgtctctggcaggaatgaatgaagcaggcttgctccgattgtgatagactctgtgaggttgtaaagcacctcagcaagacgatcctgctgtgcctcgtcctttgcaagcacccaaggtgttgtctcgtcgatgtatttgttgcagcggcggaaaagtgcgaatacctctgtgatggcatctgccacacgaagtccttccattttctttgccactttatctcttgtgccggtaacaacagccttaagatctgcgtcaatggcagtctgatctgcatcgcctgttgcgcctgtgctctttacgattccgtcaaaatatttattgctcatggaaactgttctgtttacaaggtttccaagtatgtttgcaaggtctgagttgaatctctcgattacaagatcccatgtgatgattccgtcgttctcgaatggcatctcatgaagcacaaagtaacgtgtggcatccacgccgaaaagtctgaccatatcgtctgcgtagataacgtttccttttgacttactcatcttgtcaccgccctgaagcagccatggatgtccgaatacctgctttggaagcggaaggtcaagtgccataaggaaaataggccagtaaatagtgtggaaacgcacgatatcttttccgataaggtgcagatctgcaggccagtttttcttaaaaagctctgatgatccgtcaggatcgtagccgatttttgtgatatagtttgtgagggcatcaagccatacatacactacatgctttggatcgaaatctactggaattccccagctgaatgatgttcttgatacgcaaagatcctgcagtcccggaagcaggaagttgttcatcatctcgtttttccttgaaaccggctggatgaaatcagggtgtgtgttgatgtagtcgatgagtctgtccgcatatttgctcatcttgaagaagtatgcctcctcctttgcaggctgtacctcacgtccgcagtccgggcattttccgtccacgagctgtgactctgtccagaaggactcacatggtgtacagtaaagtccctcgtatgagcccttgtagatgtcgccctgatcgtaaagcttcttgaaaattttctttacacatttctcatggtcctcatctgttgtgcggacaaaattgtcatatgatgaatttaccatatcccagattctctttacctcacctgaaatctgatctacatactccttcggtgaaattccggctgcctcagccttttcctggattttctgtccgtgctcatctgttcctgtctggaaatatacgtcgtatccctctgctctcttgtatctggcgattgcgtctgcaagaatgatctcatatgtgtttccgatatgaggcttgcctgatgtgtacgcaatggctgttgtcatgtaatatttacctttgtttgccaatttagtttcctcctgtttttaatgcttcgcacatatagtcttctataatgccgtatcacatacaatatatttctcagaaaaaatactatatttattttctcagaacaactgtatgctctccggcaattcaatatattacgtgtgaagccgtaataataaaacaaaacgcctcctcaggagaaaactcccaagaagacgattatatcgtggtaccacttctcttcacgcagctatcaaaatcatccggcatcttttgccggcactgctgcgcctctttccgctataacaggcggttcctgtcagtatctagccaatggttcgatactgctgctccaaagccatgttccttctactttaggtcatcccctctcagcctgtgtgggatttctctgtaaatctgccataaaagtactctctttttcgtcgcttttatctcatacatttctagagtagcatgtggcttttaaattgtcaactgttgtaaatcaacttttcttttaccaatcttttaaaatgcattctgtacttgtaactgcaaaataatagagcaggctcaccctgctttcaatagctttctatttggaaactcagagatttccagcattggtgcttttttctgcatatcctcttttgtacagccctcagtccttgtaataggataaggcagctcaaattccatgcttgttccctttctaagtgaaaacgatgttcccggcatatcagggtacattgtgcaaaaaacattctcactcacaagtgccatataattatcgcccataagactatagcgatccagcatcagcccgccttcctctccaaggtcgcagtctttattatagatacgaacctttaacagacaataaaatggagtattttttactgttgcttcatctgcctgccccatattataacgctcataaagttctcttgtatctactacctcatagcccagaacctgtacagcatatccgtcgatacactcttcaacagtatccacataatcatttctaaaatctacagtttctcccacatcatatatgtataccggcactctatcagcatttttattaaccacaattacacgagctgtatacagaataagcaaaattaacccgcaaataataagcactctttttctcacccgcatatcctgccctccttaagttttacaatttcatcagataattcctccaatgtctgcatatcatggcatgaaatgatcacaagtgctccccgctctttctgttttctaacaactgatttaaccatttcctttccatcatcatccagggcatttgtcggctcgtctaatactacgatatcgggatttccaagaactgctgccgcaatccccagtctctgtttcattccaagtgaatactttttatattttttccttcccgcctgccccagtcctacatcatcaattaatccacgtatttcattctccacgctctttttatccacattaccatccacttttgcaagaagctttaaattatcctctccggaatacatatccaaaaaagcaggattttccagtaaaaatccaatactctccggaaaatctatatcttttccaagttctttgccatcaatacacaccttgccactcgttggacggatcaatccgataagtgctctcataagcattgtctttcccgagccgtttattccctgaaatccatatacttttcctgatgacatatccagatttatatcctcaagcactatacttttattgattgttttacaaagcttttctacctctatatgtgccattctagttttcctcctgaataatgttatactttttgaaccttatcacacccactataactgttataaatattatcaaacacatagcagggagtgccgctttgcaatctataccatcctcatttatccacgaatgccttatcagcattgcataatttccaataacaaacaggctttgaaaatatgctgacagcagcaaaaccatgcacattaccataaaactgtatatcggcttaagccagagtcccagtgccatttgtatctgacatattgctacagataacataaaaaccattactatatctccaaccggcattattgcatgcggcttaagtgacgtatctgcccccagattaaaaagaacagtctgcatatctgtatttacctgcattccggactgtatgccgcttatactgcaaaaagacagaattaatgtaaaaattatcccaaagaaaataatattgcagagcagattccatatacattttgacagccaccatttcacacggctttttccctttatcagaagcttatttccgaaaccgcataaattattcatgggataactcagagtcacaaaaagtatcattacaaaaagcagcatccatgtcactggaaattgaaacacattttccatagacattttatatttttccataccaccgaaattatatagcagaacatctcccatatgcttttgtgtacttataccatactgcgcatacgaattcattttctgccacagcataaacagtacagccatttcaaatataaccggaaacaataataatttcaggttttttatgcagccatattttatgtcataacataacaatttccacattttcatatatgcatcctcacattacatcctttttatgcatcaaaaccatattaaccgcaattgttatagcagccattaacatagacattaaaactatgatccaaagttttgccggatatccggtctgtacacatttggtaaaataaaatggtgaaaattgataattttctgccccaggagtatttgaaaacaacatattattaagtacatttaataccatgcagacaacaaacggaaaaatacaattaacccatttatatttaataaattgcgccgacagcatcgtaatacatgccaaagctccgcaaaacataaaatcaaccagcatatataccgctacataagcaaatggctgcgtataatacaggcttgaaaatagagaattgccaaaaacaccatacatagtgtcgtatgtaggaacaggtgttattgccggaataaacagcgcagtcagcataaaattgatgattagcggcactaccattgcaagaccaccggcaataaatgttgccagaaatttggctgtcagatagcttttctctcctgctcttaccagcatctgacgcatatatccgctgtttttttctccacaaaatgaccagccgtacggcaatgctataagcagcggaaacacaaaaaagtatagtgatgaccctaacgaaaagccttcaccaccaatccaatgattaaataacgtaaatccctcataacaaggattgataccatcatatatctgactgttgtatacaagatttacattataaaccagccctactatgcctatcatagttcctatgattatagatatggcaaaatatctggtcttaatcgccttgttaagctcaatttgtaatacatttttcatatgctactccaatccgggatctataaactgcctgttctcttcatcaccattaaagttcaccgacagataaagcttgcttaagtccatattatcaatctgcagcaatgccggatctacacaaaatcctatctgagcgtcaagcgactgtccctgcaccagtgtataatcatatatcccatgctcattgtcctttgcatttgaaaaataaaccggatagcctaaaagctgacagacaccattaatatcatataccagggaaatatcccctacagtgcatatttcatcctcgatattttttacagatatatcgcaaagcagaagctttccgcaggccacctcatcctttttcagtatcgcaggcttttcgggatcagctcccatataataatcggtttctataagtttatcctgcacaccatcaatttcagccgcagtatcatatatttttacactatttacaatataacttttggcaacgtattctctatttgtgccgtaatccacgtttttcacctgaatttcatctccaatattataaatatcactttcattatctatcactatatcctcaacctcaggtctatcgctttcatcacctttacccaggttgccgtagctttgtttttgatttgacgagcagcctgaaaatgtggttataagcattgaaattgccatgattgcagtgaatatttttctcttatccataaattttctcctaccacttataattcaataaaatgattgaaaaatccaaaagtacccttgatgcttgcatgcttgcatgcttgcatttttaagtatatcttttggcccttatatcataagtattatgcttgtcaattgacactttcatattacctcattttactctcatataactgtatttcttcttaatagtcaaaaatgaggagtgagcggttcttatcaaccattcactcctcattttcatccacttatccataaattacaatttctttataaaaaaatatataatagatttattcatgattttatgcgaggagacaaactatgaaatctattggaaaatgcttatcagaaagatatgttttaaatggaattattgaatctcgttttagagatgcatatgcttatatttttgactacatgtttaatttcatattatacaatttatcactattaactttaggttttttatttcaccatccgatagccgttacaatatatattatcattacaggatctttacgtgctgtaaccggtgggtatcattgcaaaacacgtatttcatgctatatactatcatatactgtattttctatatatcttttaactattgccactatacctatgatttctgcatatatcttgatacccatatatattatttgctggattttaatattagtggtttcacctgttgacacacctaacaaagtatttagtaagtcagctaaaaagacagcccggaaaaaaaactatattatttttttcttcaattccatatttacaattctgtcacttttgttacactggaataagggtttaatttttattgatttaagtctcataatatgcgcaacaggtctttataccggatatatttcaaatataaggaggcatcatgaatcttaatatagcaatatgcgacgatgatacaaacgatatcgcaataatgaaaaagaatattttacaatacacaatagaaactgataacaacattgtcgtatcatcttatttttcagcgagtgatatactttcagactacaagaatcatctctatcagatagtacttctggatatagaaatgccagacataaatggtatggaacttgccagacaactccgggatatggatgatgatctgctcattatatttacaacatcctatccggaatatatgcacgaaagctttgaagtccagccatttcaattcataacaaaaccggtcgactatacagctatatacaagctttttaacaatattatcaaaaaattatatcgaaactcaaaaagtatcgttataattgatactgatggtgaaaaaaattttgtacctttaagcgatcttctttatatttcatcaatgaaagaaaataagttacatctcagatatcaacttactgacagagcattgatatccaaaggcactttatccgaagcagaaaaacgactttcttctcacggatttgtttcaccttcaagaggatttctggtaaatttacaccagatcagatcaattacttccacgcggcttttactgaataacggctttgaacttccaatcagccggagaagatccaaggaattacaaaatatctactctcagcacattattaatatattataaatttaaggagacaagtttatgaaaatagtattgttgaatttattggacagcatgatgtccggtgcagcagcctttatattttttcagacaattcttggaaagaagaaatcccaactgccatattatataatacttctcatatttgtatgcagctttactatttatgcagccattacatctattttaattggcaatacatcgacactggcagtttatttacgtttaaccttatcatctttactttgtttctgcctaagttttctttattcagccaatttgcgaactaaaatacttatatccatcagtactactatattatgctctatctttgaagctttttcgtattacattattacaagcatttactcatatcgagttgaaaaagatactatggattttttagtattctccaatatatcgcttatggcgaatatgtttttccttattttttcaatactgattcattttatctggaaaaaggaggcttttgttcattctttaagttatacaataattttattggttattccggtactttctatgtgcctgttactatcaaaaccaattttatatctaaatataaatattccgtctgcctttttcattttagcagcctttgtattgtttataaatattatgaactatatattgttttacaacgtcctcgaaaacgaagagctccgctttcagcttaccatccaaaaagaacagattgaatttcagcgcaacaaatacgagcaactgggtgctgcctacaaaaatatacgtagctttatgcacgacaccaaaaagcatctgttttatattgaaaattgtgttactgagaaaaaatatgacgatataatcccttattctaaagagattatgcacgacctcgaatcacgctattgtactattaatacaggaaatctcgttatagatgcctttgtaagcaacctgctgcttcagacaaaagcccaaggtatcactctgcacaccaatctgaaatttgacaaagccactattcctgtcaatgattatcacctgactatcattctcggaaatctgcttgataatgcgcttaatgcctgccgtggacaaatcggagcaaatatcaaggttgcggtaagaactgtagacggcacctttaccatacacgttgcaaacacatatgtgattgcagatcctgacaaggcacctgatgattttgaaaaaatagattttattcacggatatggtctgaaaaatgtaaaggactcagccgaggcatgcggtggtttctgcgtgatcaatcacgaaaatgatatatattccgccaccgttataatacctgttctgaatccttgaatcaattcatccacaaaaaggatgaactatccctctgaaatctgacaaacgacacgattttctataacaccttcgaaccatttgccgtaagcttaaaggttgcacctagcacctctgctgcgccacggcacatcatcattcgacccaggaaaatttcaaaatactcatacatagagcagattttcgtatcaatctgcagattaagcgctatgacttttttatccatatttatcttaagagctgcatctgttactgcataatttaccctgtcgtgtatatcaaaattttcttttgccttgttccttacacggtttctgcgcacatcggttttatctgctatgatgagtgctgctgaaataggatccgttgcccctccggttgactcatcatgatgtcctatcgcagacacaaccgttatcctatccttcagactcatatctgtttctttgagtatctcgtttgccagtattgcaccatattccgcatgacggcttctgtttaccacatttccgatatcatgcataaatcccgcgatttttaccatttcaatatcagattcgctgtaaccgaatttctttaatatatatgctgctcttttggctaccattgtgcaatgagctgccgaatggtctgtaaagcccaatactccaaggttttcattccctttctttaaacattcacagacctccttattcttttttatctcatcgtatgtcaaattattgcctcctgttttgttacttaatcataaattatagtctgcttttcataaaaatattcgtacatgttttgtaatctttatttctgcacttataagcgtaacaaataattgaaaatatattgagatggctgtgtaaaatttgtgggaaattttctatttactattgatatattttgcattgacatattttgttgcatattttcctcctttatgcatatatttgactaaaaaaaatgcagatactcaataagtatctgcacattttctaagtaatattatgcattaaaggttcaaaaggtattttaccctatcgtataataatatacgctgtatatgctgcatacattagcagcatgatgatgccctcgcctctttttatctcacgttttgtccatgccataatccacacgatgagtgaaaataccacaagcacgataatatctatgatattttcctgtatgaatgctatcgggctgatggctgatgcaattccgagcaccatgagtatgttgaaaatgcatgagccgactgcatttccgagtgccatatcgacctcattttttctggctgcgactattgatgtcacaagctccggaagcgatgttccgatagatacgatggtcagtccgacaagtgtctggctcattccaaggtcaatcgctatgcggcttgcactgtctactacgacatctccgcctactgcgatgccgacagctccgatcagaatgaaaatcactgcttttggcattgagatgagaggtatctcatcgacctcctcatctgatgactgcctgttctgctttaatgtgtgtctgataaggtagaaaatatatcctgcaaagcagccgagcagtattattccgtccactctgccgagtgtcatgccgattgttcccatgacaagaagtaaaatggcacatatcatcgaaaatgggaaatccctttttaatgatgctccgtccaccactatcggtgtcatcaaagcgcacacgccgattactaccatgaggttaaatatgtttgagcctgtcacgttgctgactgcaagcgtattattgtgtgctatggatgctgccacactgaccgctgtttcaggaagtgaagttcccatcgcaacaattgtcagtccaatgataagcgacggcaccttgaagcgctttgccacgcttgagctgccctccacgaacatgtctgcgccctttaccaaaaacacaaagcccactatcaggcagatcaacaccactataaacggtgcattattgatgaaattttccatgttgattcctccattttttattttttaaaagcatataattcccaggtgctcaagcaatatcttcacacctatgagtatgagaatgattcctccggctatctctgatttctttttatatttattgccgaaaaagtttccgactatgactccgatgattgagagcacgaaggttgtaagtccgatgattgcaatagcccagtagatgtttaagctgtcataggtaaatgcaaacatgattccgactgcaagcgcatcgatgcttgtcgcaattgcaagcagaagcatctctccctgattgagcgccaggtctttttccacgaccgcgtcatcatccttttcctttactgcctcataaaccatctttccaccgataaatcccagcagaatgaatgctatccagtggtcaatgcttgtgatgtacttctcaaaccggatgcccagcatatagccgataaacggcatgagcgcctgaaatcctccgaaatacagaccgattgtcagcgcctgctttctgtttacctttgtcattccaagtcccttgcagatggatactgcgaaggcgtccattgacaaacctactcctatgagcaggatttcaataaataataccatatttttctcccttttgcctagtgtgcggcgattaattttcgtttgtaccgggctgtctatgattttgcaattaattctgcaatatgcatatgaaaaaatgagaccctcgcatgcagacacgaaaccttataaagctataatttatggcttatatagctttattgtgtgctgcatacttgagtctcattctttaatgtttgccaggtctattgaccggtctgttgacaaaccacgtatatgtaatgatacgcgaactactccctcagaggtagtgtgtatttaattaatcgcctttgcttctaaaaaaatatatcaaatgacatgggctgtgtcaatgtattttactgctaatctttgtacggagtggctaactttttaaaataatcaaaacacccggaacattttttacaaaacaaattttatacagacttacacaactaattattttaaaaggctcttcattagtatgtgttgtatagaaaattggctcaaggccgtttaggtattgaaaaaacatatgggctctagtatgattttttgcctagaaaaaattgtaaaggaaagagtcaccatatgcttaacaaaaattgtatcaaaactatcctaaatgtcaagcacacttgtattgataaagttactatgcttgctgatacctctattatgattcaggtacatgccactaaatgcgagcaatatcgatgtggcatttgtggtaaaaaatccaagttctatgacaatggcaatgaaggtgccagaacctggagagcctgcgactgggcaggtcaaaaagttattctggttgtcccttcctgcagagtcaactgtaaggagcatggtgtcgttacatgccactttccttggaccagacatggctcccgctttacacgcaaatttgaagaacagactgcttggatggctgttaactgttctcgtttagccgttgctgcattcatgagaatttcatggaatacagtaggttctatcatcaaacgtgtcgagaaagaccttgatattaatcctaatgcccgctttgataatctcgttcgtattggcgttgatgaaaccagttatcgtaagggacataaatacattactactgttgttaatcatgatactggaaacgttatctgggttgccaaaggtcatggaaaaactatatttgagcaattctttaaacagctaacacctgcacaaagagaaagcattcaattaggctctggcgatggtgccaggtggattgatgaatgcatcagagaatactgcccaaatgctaaccgttgcgtggatccatttcatgtaattgaatgggcaatggatgcccttgatactgtaagagttgatgcttggcgagaagccaaagcaaaaactccggaacaaccaaaagctaaacaggacgtcctaagaaagaaacaccttcgaaggatacaactgcaacagagcttaagaattcaaaaatggcattaggaaaagctccgaagaatcttacgccaaatcaacaggctaaggttgaatggattgctaaaacagatcctcgtttgtatcgcgcatataaactcaaagaagcattacgtcttgtcttctacaatgatactgtaaaggaagcaaaggaggctcttgatgcctggtttaaatgggcaagacactgcagaataccagcctttgttgaacttcagaagaagataaacagacatatgcaatctatattaaataccatagagtatggattaaccaatgcaaggattgaagcaatcaacaataaaataaagctatccattcgaatggcttatggatttcgaaacttagataacatgatggccatgataatgcttagatgctctgatatcaaagtgaagttgccatgggagaaagatgaatggacttctttcttcttcttcgattagggtatctaatattgaattcagccacaagggtgcaagcaccactccgtggaaccccttgccccctaaattcaataccagataaaaaataatcaagcagaaaaaggatggaggtgctatcagcggcagctaaacgctcacacaaactgatgatgcctcaaactaaactttttgaccatgctgctcataacggctcaaactatcttaacgggcactgttttgtaagtctgatgctgtgtgttcctgtctggaaccatgataaaatctcatatattgctgttcctctcggataccgtatgtggtaaaaaaaggaatcaaaacttgagcttgcggcttccatggtgcgtcaggtcctgccagaattctcacatagtaaaaatgtaattattctttgtgacagctgatatatgaaacagaacctggtttctattgttgatgaatatgaaaaccttgatctgattggaaacgcaagacccgactctgtcatttatgaccttgcaccggctcctacaggtcacaggggcagaccggcaaaacacagaaggcgtctttcgatagaagatgattttactctctccgatgaaaaggttggggattattataccggggttcgccgtgtcctgacaaatctttttggaacacccgaggttcttgcttatgttacatcaacagccagaaccggaggaaccaaacgcctattttttagtacgataacgcctgaagaactgcagattctctgtgcatggcaggaatcttcacctttaaatcaaaccggaagcgaccggatgaaatatattccgctatttctctattcgtttcgctggaatattgaaatcagctactatgaacagaaaactttctggtcgctatgcagctatatggtacggagctgcaagggcattgagatgatggttaatctgatcaatgttgcctattgtgcgatgaagttattgccatatcaggatgaaagcttttctgatttccgagataaaagcgtgcagtattttcgttttgaattaagcgagggtatacaccagcaggtaatttttgccactttggtgcaaaatatcgaaacccaaataaaatcatcctcagtgataaacgccttaaaacaggcgattgtagggctggagcattatttataaagttgtaaaatggtgttttttaaatataaccattgttttttaagaaagtatatattccatcttttcttggtgcattacatacataatctgccatatgttgcaatttttcagaaccatctatatctttaactgctatgcctatttttgcattttcaagcatttcccagtcattctcctgatctccaaatgccatataatcatcttcattaaatccatagtatttcatcatttcacgaatgcctgtttgtttagatattccctttgccataacatcatagcaaactgtaggacatggcacaattcgcgctgaaatatctttttccagttcagaaaaatcgtaacccataggagcgaatatattaattttcacaacctcctcacctttccattctatatatggtgggatttcttcctcataatatttttttccctcaaccagaaaatcagtaattttagtagccagataaggaccatcaactgcatcaaatatcaaagacatattattgttattacaatactctaatattttttctacatcttctctcaaaaagggaaaatcctttatgcatcgcaacgtgttgtcatatatcgcagcaccgttattcaaaacatatgcatcaaaaacagatatatctaaatcctttatatcacgtatactgttaatatcccttcctgtagccagtgcaaccttatatccgttttttctcaattcctctattgctttaatagaagaagccggtatttttttctctacgcaatcaattagcgttccatccacatcaaagaaaactgctttcatttccacctcctaaattccttgccagtctgcctccatttccctacacatttcaaatttaagaacctgttgttttcctgtagatatggcattttcaactaacttatcaatatttatgtccatatcacgcatcataacattttcaatcagcatccctaaattagtaccacttattattttaatatttttactactcgtagcagcaatttctgctgaaattttaaatggcgagccacctacaatatcagtaaaaaatataatatttttacattcttctaatttgtctaaagcctctgttaactttatcttcaactcttctgttgaataagtatccgggaaatctactgtttccagatttttctgttgtcctgcaaccagtttcactgcactggcaattcccgtagcgaaattgctatgtcctgttataataattcctaccatttatatatcctgcctattagttatttataaaactcttaatttcttaattgtgcgaacgtagtcaccctttccaaaaagagaagatgttccaagaataaaaccttttacacctttttgattcaatttttttattttctcttcagaaattccaccatccacaactatttcataatgatattttttcctattttgaataaattcctctattttttcgtcaatatattctaaatatgattgacctgcaaaccccggattaacggtcattatcattacataatctactatatgtaatatattttttacagtttcaaatgatgttgctggatttatggctaaacccgtttttttcccatatttatgaatattgtcataagtacgtgcaatgtttacatccgtttcataatgtacataaacaatatctgctcccattttgcaaaatatttcagataatgctaccggattttccaccattaaatgtacgtctaccattttttttgtgttttctctaatacatttaaaatcctctaatcccattgcaaaattgggtacaaaatttccatccattacatcaatatgaaacacatcagcacctgcttcatccaattttacaacttctttttttaaattattaaaatcggcacacatcattgatgggcaaagtaatttttccatattttggaccaacctttcaaatgcttttgtaaaggtccaaaatactcttaatacaatattttggaccctttaatttatatcttgtattttctgtcatttggagttatctggatatacacatctactcctttttctttcagccgtttcagacacgcctcatcctgatcatccacgtaaacatggacttcatgaagtatatgcttaccttctgatttatgcatgtttcctatattgcaatgtttaataggaactccgccatcaactaactgttcaatcacctgtggagtttttgcaacaataaatatcttttgtgaaggagcagcctttccaataatctcaatggtcttttttattgagaaaaatctaatctgaactcctacggcatctgcagtcattttcattaatgattttgataactcatcatgacatgtttcatcatcaacaactaaaattaaatttgcaccacttgccgtaacccagacatttccaacctgtccatgcaccaaacgattatcaactcttgtaaaaacaatgtttatatccgacataccatatttcctcctataaccatcctaataatgacattaatattgcaaatgctattattgctaaaattagtactactatgcttaccttcttctttttgaagatataatatagtataccaacaaacaatgctggaagcaaattaggtataactgaatcgaagattgattgtactccaacagtaccaaataattttaatttttccgggaacgcaaaagttacataacttggaatcattgctccaactaccattacaccaagaatacctgcacctttagttaatgctttggcattttctgttaatttagatattgctccacttcccagtttgtatccggcttttaggaaaaatactcttgaaactgccattaaaatccaaaatgccaggaagaatatcggtcctaatattgaatgctgtttacacaatgaggctgctatacttccgctaataggtaataatgtaaaccaaaatattgcatcaccgatacctgcaaaagatccaaaaagaccggttttcatattttttattaattttctatcagctctattttcttccattgatagaactaatcccatcagaaaagatgcggcatgttgttccgtatttataaagtcaacaccgtactcgtccaacgccttgcttacttcttcactatcttttccatgtattttctctaatcctggaagtatgctccagccgaaactattaccctgcattttttcaaaagtaaatcctgtctggtagaacatcgaccttaaacccaatttttttaaatctttattggtaagtttatttgttgtctcattatattccctcgccatcatcttcacctcctgttactactgatgttgtttttgcctctttgtctctcataaaatcaatcagtactaatgcaattgcaaataaagctactggtaaaacattgtcaggtttcataatgctcataattaaaaatccgataatcagatatggaacattttcttttttaaccattacctttaacaatagtgcaagtccaagtcccggtaaaagtcctcctgctatttcaaatccgtgtgaaacgaattcagggaatgaattaacaaactttgataatacattctgtaatgcatatgtgcttaagaatgcaactactgcataaagtgatgttaaaatcatttcaggtaggaacacataaaatttaaattttttaatgtcattttgttttattgcctgctctacttttacgttaaatcctgagaacaatgactgacacgcgataactatccactgcataagtaatgcgaatggtaaactaagtcctaaagctgtttctgccgatactccgctcttataagccaaaacaactgtcataagacctgcaatcaatgcattaggtggtactgttccacctactgttgtaagtcctaagtaggacaattctgctattgctccggcttccaaaccaagtttccaatctcccaatacaagccctgttacaaagcagatgataataggatggaatacaaagaagcattcccatctggcatcccacgcaaatgcaaatacaatcagtgacagaatcagtccctgcaacaatgtaacactcatagttacacctcctccttattattaatttaaaaagttactgtagtttttgataagccaataggttcatccggattatatccccttgccaaagataagagacatgcaaataattgtgaaaacacagccattccaaacactcctgcaacgccttccgcttctttcggcaaaagaaccgcttcgttagccattgtaatatatttttcattatttgtaacaactaatgtactaacagaaaaatctttttttattttctcaacaagttttattgtactatcatttgttttttcgtcagtcaaaaagaatattacaggtataaatctttttgtggttgctattggtccatgtggataatcacaggatgaatatgcctttgcatttgtatagctagcttccattattttaagttcagtttcattagcaactgcataaccaaatcctcttcccagtaataaaatatcctgaacatttctaaacaaaggaacgcttttctttacctgttcttctatattcttacacaaactttgttctataatatcaggtgctttttttatctgttccaacaatttttcatcgtgtgaaagcactgctgcaaataatagcgctattaccgtttgagacatatacgacttagctgccgtgaaacttgtctcttttccacattcacaatttatataataatttcccacatctctcataaggcattcgcgttcattggttactgctactgcaatgcctccctgattctgacatttttccagtacagtataaacgtcctttgcctcaccacattgagagactccgattgtcaaaacatctgacaaatctacttttccattcaacaatgttactattgaaggataagccatcgacgttaatttatcggtataaatctcaaacgcatattttcccactaataatgcatgctcacttgaaccccttcctactaaaagaaccttactgatgttcctattatctacctctttacatatattttctattataggcagattcacatcaattgcatgtcttattatttccggttgttcatgaacttctctccacatattagatttacttacatcgtactcatacattattttttctcctttcttattttgtaactttgtaatgacaatgttatattataatatttgtattgaaatgtcaacttttttttgctaatattttattaagagcatatatagtcatagctctatttgctaaaggagatttttattatggattatattacaattaacaagtactctctggttcctctatattcacaattgaaagaatcaataaaagaggcaattcaaaatggtaccctaaagccaggagataaacttccaacagaacatgaaatatgtaaccattttaatctgtcaagaaccgttacaagacaggcattttatgaattaatgagtgaagggtacattatccgttacaagagccgcggaacatttgttaaccaacaaagtaaaaagaatgtattttttaaggaaattattagttttaatgatgaaatgaaaatgtatggttttgaacccaagacggaacttatttctattgagaaatttatttgcaatgactacattgctgagaaatcagaatttaacgttggagatgaattaattagaattcaacgattaagatacagaaacgatgatcctattgtttttgttgatggatattaccgggcttctgacattcccgaaatcgaaaaacatgatttagaaaaagaatctatgttttacattttagaaaaatattataacataaaagtcatgcatacaaaaaaaagatttatggcacgaatagttgaagacaaatatgccaattatttgtccataaagaaaaagtctgctgttcagtatgtagaaagtaaagaatataatcaacaggatgaatttgtttcttttgatatttctatttatgtgggggaaaaaaatatatttgagacagaaattaacaatcttcccaaagttctccaatagcacacaacttattatttttaaattatccaataccaccggcttagccggtggcttactcttcacctgaaacatcgtttttcatatttatcctgaattattcacggttgtatcgtgaaagtggctgaatgccatatggttactgtattttaactgaatactgcttttcatctatcaagtgaataaaaaaagagcatccatttgtggtaaaattaaggtgtctaaacaaaataaataccaacaaaggagccctttatgagtattgtaaacaccttatcattagaaagcaatagacagattaaaataaattttgatggaggagatctctcctcagatgcaggtcttcttttgctaaaagaattcgctgctaaaattggcttcaccaagctgatcaaaaccaaatttaaaaccaatgatacgtcagtccgtttccacaaagacaatgagaacctgatgcagatgatttatcagattatctccgcctatttcgaggatgattgttctgatgaactgacccttgatcctgtttttaatgccattcttgaaaagaacggtctggcttcacagccaacactgtcaagatttttcaaccgcatgggtgaagatacactcatgcagtttgacgatattgataaaagccttagagatatcatctattctataaagcgtccggaacatatgcttctggatctggacagtactttatttgacacctacggcaaacaggaaggagagggcttcaacttccattatcaggcacacggataccatcctttgctctgctatgatgatctgaccggggatctgctaaaggcagaacttcgtgatggaacactccactgcagcaatgatgcagataaatttatggaaccactttttcaggaatatctggaaagaggcatcaaaacatatcttcgtggtgacagtggattctcatctcccaaactttataaaacctgtgagatgaatggctgttcctatgccatccgcttaaaacagaattcttcacttatggctcttgcatcggataaagataaggatttatacaatgcaactaaagaggatcagatcagctatactgtaacttatggcgaatttctgtatcaggctggttcctgggattatccaaggcgcgtggttttcaagattgaaaagccatacggtcagctgacgcatatgtacacctttattgttacaaacatggatatggaaccttaccaggtcatccagtattactgtgggcgcggcaagatggaaaatttcataaaagaaggcaaaagtggatttgactttgctgctgtcagcagtcattccaaagtagtaaatgccaaccgcatgagacttcacatgcttgcctacaacttattcaatttgtttaggcgattggtactccccgcaaatatgcgaaaacaacaggtggataccattcgtttaaagctgataaagattgctgcaagagcagtccgttcagcaagatatataacattcaaactatgcagtagctgaccttataaaaaagagttctacaggacgttggaaaatatccagaagctgactgtacagttggagtagcaattattaacgtaccttgacagttcaagataactctatcggatttcagaggggtagtttacccttttttgtggatgaatcgattgttttcatgtgaactggttcaaggatttgtagtgttgagcatttttatatgctcatgaataattcaggattaataaatatgtacatcatgatgaaattaaacacttgatacaggaggtgaataatgctcaatataagcagcgatgtcatccgcggatacaacgataccatcatactctacctgctcctcgacagaccatcctacggctacgagatttcaaagcagataaagctaatatccgaggaaaaatacgtcataaaagaaacaactctctactctgcatttacccgccttgagaaaaacggttatatcacatcattctcttcgagcgacaatgcaagcggcaaaaggcggacctactatcagattaccgatgccggcagagaatattacaggatgaaatgcgaggaatggaagctgacacttgatgtagtaagcaaatttatacgattttaaaggagacattttatggaaactataaagaattatctggaaaatatgttttcgcacctcccgaatacccccgaggtgcaaaaagccaaatatgagctctatcagatgatggaggataaatacaatgaattaatatccgagggcaaatctgacaacgaagccataggcatagtcatatcagagtttggaaaccttgacgagctcgccgactcactcggcatcaagagcttcgtgaatcccagtcaggcaatgcctgctgccaaaacactctcccgcgaggctgctgccgcattcctcagggattcggcaaaacaagcatatctcacagcctttggagtgctgctttgcataatcgcaagccttggaccgatattcagcgaatgcattccgcgttcactcgcttcccctgacgcatctgatgccatcggcattaccttcctgttcgtttgtatcgctgtggcagtcggcttctttatcttctcaggctctatctcatccaagtggagctacctgaagcaagagccttactgcatagattttgagacggcaaactgggtcatcgagcgaaaggaaagctaccgctccacacatgcgatgcttttaacagtgggtatcatgctctgcatactctgcgcagtgccggcaatcataatcagctcgctgaacaccaaaagcaccttcgcagactcactttccggtggactcgtgctcgtgtttatagcaatcggtgtattcatgatagtattcacaaacatgaagaaatcaagctttgacaagcttctttccctgaacggagcacagactatgggcggtaattttgccaattcacacgatggcaaggtgcactatgaaaaccctgttgtggctgcaatcatgtcagtctactggtcaactgtcacatgcatctatctatgctggagctttattacctttgactggggtatcacatggattatctggccaatagctgcaatcatcaattcgctggtggaaaatctgctcggcgataaacatggaaattaatggaaaccaggacagtcaaaaatgtgtgtagcatattttgaataatcacaaaacaaattatgcaacaagataattcagaaatggagacaagtcatgaaaaagaatatatatctaataataattacaataattacagtggtctgcatcatcgccgggagtctctaccatatcgggggctttgccctaggcctgtttgacaatctgattccgcgctcagacaagtctctcggaaacgtatgcacagaggagctttcagtcgatgaattttcaaacctggtatttgatacaaccatatcgaacatcaatgtgaaaaccggtgacagctacatggtctcatacaaatgcaacaagcgactggttccaaagattaggagcacaggcgataccctcacaatatcccaaagcaaaggagccaactatagaagaaacaccacgagtgaaatcactgttaccattcctgatggcgcagcattgaacaagctctcccttgataccggcgtaggcgaggtaaaccttaattccctgaccgcagccgatgcagaatttgacaccggcataggcgatttatatgtcacagactgcagctttgccacatgtgatgtggatggcggaaccggcaatcttagctttgaaaactgtgcctttgacgaaatggatatcgacggcggtacaggtaacatcactgtaacatcctcacagtcacttgacggttacatgatggacctggactcaggtacaggcgatatcacaatcaacggcaatgactatgatgatgagtatgaggtaaatgagcatgccaaaaagcacctggttatcgactcagggcttggggatattgtggtgaaatattaaattaaacttttcactttttattgtccataaactgcggctccatatatccggttcctgacatggacttatagtagcggcttgcggcctgcgtgccgacacgcacctcgcgggcctgcttctttatggacgcaaatttcagagtcatgagatccttgttacgggcctcctgactctgtatttttacgctcttgtccgtgatactgcggatatgctcctgcatggtgcgtatctgctccttgtagtcctctttgtgaccattcagttcttcctttgtacgttcaaaaagcttctcaaagcctgagtctaaattattgagctggtcgatgagcctgctctttgcctcaactacctcgtcaaagtcgtcaggtgtgagctgtggatcctcgagctggttcttctgcttgatatcaagctctattatccggtcgagtacctgctcctttttctccaggctttgtatcattatatctatgtatgtctgttccatggtgttctccctgtatttccaattgttttaactataagcatctctataatagcacaaaacgcacaaacaaactagcttcatgctgctgtctctgcgttttgtttaagttaaaaactctctataatccctgtcggtgatttatgatacatttatctatgacacatgcaacttgtttccgttgcatgtagcctgcatgacctctttccacgcgtcacgcatagtgcgcaggtgctcaagtacctcctcaagaatctccttgtccttctttatgtttgcctcgacaaggcgtctgtgaagataagtatatacattgttaaaatcctttgataccggatatttgtcatcaagtgtggactggaactcctctatgatacgctcaaccttgcggatatttgtatgagcctgctggatatcctccttctccactgccataatagcgatattgcaaaatttgattgcaccatcatacagcatgagtgtaagctctgccggtgatgcagtcatgattttgttgtttgcatatgctgcgtatgctttattttgtaacataatataccctccctggtatctttttatgagaagtagctgctaattgagctctgtgtgctgttgagcttggtcatagctgactccatctgagtaaacttgttgtagtagtaatcctcacgatctgagatttttttctcccattccttaatagtcttggtgtagttagtgtactctgtcttcatctgcttgtcattgtagatggtaaatgctgagctcaaatccgtagacttcatcttgtcaccgattgcactatacagattagttgaaagctgctgcataaactgcattaccgtatccggatcatcgtttatagctgccatgagcttatctgtcttgccggatgtattggcgtcatcctcatcaccatcaatgtgatatgcattctgctcattctccgctgcattcaaaaatccaagtgtactgattccaaagcttgagagcgagtacttcttgccacctatctcaactgatgacatcatggctgtctgcattgctgtcattacgctgccaagtgtagaatccctgcgaagcagagagtccttaatctttgtctcccacttctcaatctctttatcagacatctgatccttctcatcatccgtgagtggctcgtagcttcctgctgaatcagcattgtatagcttcgtcatctcgttgatgatgttgttgtactctgtcaggaaatcctttaccttatcatatacaccctgtgtatctgtgcttgttgtaatgcttatagcactgtcaccggtctcagcaagtgcctcgattgtcagtccattgattgaatagctgttgctgtcacctgtatattttacaccgttcagctcaatctccgaatcctgtcctgcgaccttcttcacctgtgaattgaaaagtgccttattctgaagcgtgtatgcagtgtttaccctgtcgagcaggtcgtttagcgcctgtgtatactcagacgaatccttctgctttgaggcaagctcctttacaatattgctatctgctgctttttttgtgttggcctctgcggcctcctccaaagcgttggctttatttacaaagccgtcagtctcgtttccgtttcctgctaaaagctgctctactgctttctttcctccgccatccttatccttatccttgcctgccgcataagcattctgaatagcctttgtgaggctggcaaccgaatacttgtcatcgcttccgagcacttcgtcctttgaagcctcaaatgcctgaactgacgcaagagcctcatcgtatgagcttttagtcttttcgcccattgactttatgattgtgtcatacgcagctgaagctgactctatgcctgtcttgtttgtggcatcttccgcaatagtgtactcagtcttttgtgaaacagtgatggaatcagttttatcggctgtgtagtacttgccgtctgtctcgtccttcttgtaagtcttaccaccgacggtcagtgttgtcatatcatcggagtggtctatatgtgcagcttcaagctccttgccatcagcatcagtataaactgtcctcgtagattctgtcacatcatagtacgatgtggtatgcttgtccgtatcattaacggctgcaatatagtggctattgttgttgctgtcaatatacttatagagagtatttccatttgtatcggtcagtgtggtctttgtatatgtatcatagctgtcaccattctttgaaatcactgcgccatcacgagatgagccaagcttctcaagcagcttcagcttatcactatctcctgcattgtttgcatccagcttctcataaatgccctgaagtgtggcatatgaatagccataatttacagcattcataagatttttgctctgcgcattcatcttcgccgcatctgttgtcagattattgtagtttgtaacagctgcctcgattttggctctggtctcatcgtctgaaactccatgtaaagctgcatactcatcatatggattggatgaataagtaccggtagtggtcttttcaccaccatatgctattcccaggctataaagtgctgatgctccatctatattgctgccggttatggtaaaatcgtttgccacgcctgtcttttttgagctgatataaaatctcttgtagcttgaatcgtagtttgcatcaagccccgcattcctgagttcctttaccacgtcgttcatggttgatgatgcgctgagagtgatggacttggtctcgtcccccatctttacctcaagcttggcatcaccgcctgtgtaaccgagctgtgcaagtgtagtcttctcactgtctgccttaatttctgctccggtcatatatccggcctttgccatctgcttgattttcagcgactgtgtgccgcttggtgcaccggagcctgcctttactgtggcctttgtagtatccgaaactgatgtcttctttaagttgtatgctgtagaaaatcgcagattggaaatattgctgtacaagctgtacaccttggtattaagggatttccacgcatcctgtgtccactcaagcttagtctgcgccttctgatatttctcttttctggtggtatatgacgataccattgcctttacaatagaatctgtatccagacctgatgtcattcccgataatctgattgccatggtgtcctcctatctcttctcatctaccatgagtcctgccatctcccagaccttcgctatcatgtcgagcgtcttctctggcggaaactccttgatgacttcctttgtcttcttatcaactatctttattgtcacgcggttagtcttctcatggatgccgaacactgcctccgactggtcagccaacgcgctcttgttgatatcatccacagcctttttaagctgcatattcttctcattctgcttttgtgcggcaagctgtgcctgtccctgcgctccggcatcaccggctgaatcaccgcttgtttccttagtattcatcgcctgaatattccttgcgatgctgtcagacacgacctgattgtccgcactggacacctctgtccttccctgtgcctgttcctttatctgtgcagttgatgtacttccctgatagaccattcctgcacccttgattgcctctattgccatctctaacacctccgtgtgaaaatatgttgcaattgactgttgttcttaccctattctaaggaatatatcggatgaattgcgggaaagtttatagctttcttctctttttaagtataaagagattttgaaaaatcccggcccacatcagaatacttaactttatcctatgacgcaagccgggatggattgtctctttattctttttgtgttttagtcttaatgctccagatttgcaaactttgtgtactcaggcagccatgcaaggtttacggtgccgattggaccgttacgctgtttagcaatgatgatctctgagatacccttgagctcggtgtccttgttgtagtagtcgtcacgatagatgaacataacgacgtcggcatcctgctcgatggctcctgactctcgaagatcagaaagcatcggtctgtggtccggtcgctgctctacagctcgtgaaagctgggagagtgccactacagggactgaaagctctctggcgagtgccttaagcgaacgtgatatgtctgagatttcctgctgacgcgattctgagcctcgtcctgagcctgtcatgagctgcaggtaatcgatgatgacgagctttaagtcatgttcgagcttgtatttacggcacttgcttcgaagctctgatatgctgatacccggagtgtcgtctatgatgagctcggagtctccgatgattccggctccctcgaccagcttttcccagtcggcatcagacagatttcctgtacgcagtgcctgcgcatctacctttgattcgagtgagaacagacggtttacgagctgctccttcgacatctcgagtgagaatatggctgtacacagatgtgcatgaaatgccacatgctgtgctatgttgagcacgaaggctgtctttcccattgacggacgggctgccacgagcacgagatctgacggctgaagtcccgctgtcctgtagtctaagtctatgaagcctgtcgggattcctgttacggtgccctcctgctgtgctgctttctcgattttctcgagggcattcatgactacagtacggattggcacgtagtcacctgtctgccttgaggaaagcagctcaaatacatcgtgctctgtcttgtcgagcacgctctcgagcgattccttgccggcgtagcactcgttctctatgtcctctgtcacatggatgagctttcgctttatggcattttcctttacgatattggcatagtacttgatgttggcagaggtcggcacactggtgacgagagttctcacaaagtcaaggctttgtatttcctgcggcacatccttttcctttaaacggttctggagtgtaacgagatctacaggctgaccctctgtaaagagctcaaccatggtctcaaatatgatgccgtactgctgatgataaaaatcctccttaaggagcatctcgctggcggtcactatggcatccttgctcataatcatggagccgaccacggactgctctgcctcaaggctgtttggcattattcgtttgattaatgcttcttccaaggggattcctcctatccttcaactactgatactgtgaggtttgctgttacctttggatgaagcttgacaggcacctcatagtttccgagtgccttgattgactcgttaagctgcatctttttcttgtcgagttctaagccatgctgctcctttgccgcagccgagatctccttggtggagatggagccgaaggtcctgccgccctcacctgagcgcagctttactactacctttgtgttctctactacctttgcgagtgcaagtgcactctcgtagttttcctgtgctaccttgtcagcgtgctggttctgaagctttaagtcatttaagttctttggggtagcctctactccgagctttttaggtatgatattgtttctggcgtagccgtcacttacgtttactatctcgccttttttgcctaatggttttacgtcctgtaataagattactttcattcttctatgtctccttcttttagcatttcgtccagtgtatcctgtatcatgcgctttgcctgcacgatagtaacgcctgtcagctgcgcgcctgccacatttaagtgtccgccaccgcccagcttctccatgattatctggacatttatctcgtcgattgaacgagagctgatataaatcttgtcattgtactccgtgagcacaaatgatgccttgattcctattatgttgagcagctcatttgctgcctgtgcaccgacgattgtcgggctctccacattctcgctagggcataccgatatggcaaacgagcccctgtatacctctgcatggcgtactgcctcggctcttgccttgtagcatgccatgtcatttctaagcatctttctgacgcgtgttacctctgcacctgagcgcttcaaaaaggctgccgcctcaaatgtacgcacgcctgtcttcgtcataaaattgttggtgtcgatgaggatacctgcgtagatgcagtcggcctctgtcgcatttatcttgactccgtcgttaaagtactgcaatacctctgcgaccatctcacacgcacttgatgcatacggctcgatgtatgagagtataggattctctattatctcgctgctttgtctgtggtggtcaaatacgactatctttcctgtctttctgaggagttcaggacactctgtgtagcttggtctgttggtgtccaccaccatgacaagagtatccttgctcaccatctcaagagcctcttcgctgtttataaacatatccgccgggtagccctttgcctctgaaaatgtctccataagaggtctgactgagcttgtcgggtcatttattactatctgtgcctttttgtcgagattcttagctgcacagtatatacctatgcctgctccgagcgagtctacatctgtgatgctgtgtcccatgataagcacgttctcacaggtctcaatgatttcctgaagcgcctgtgccttgactctcgcctttacccttgtcttgctctccacctgctttgacttgccgccaaaatacaggatatcgtcatgatcctttataactacctgatcaccgcctcgtccgagggccaggtctatggcatttcgcgcatatacgtagttttcattatacttatcgctctttataccgattccgatactgagtgtgaccgccatctcgttgccgacctttatagccttgacctcatcgagcaccttgaacttgtcctccttcatgctgtcaagatacttgtacttgaacaccacgaagtatttgtcgttttctatctttctgacaagtccgtcatacttggcaaaatactggtttacacgcctgtcgataagtgcaacgagcagtgacctctttacgtcctctatgctgtcaagtgcctcatcatagttatcgatatacacaagcgctgagacctgcttctgctctgtgatttccttcttgcagtgataaagctccgactcatcaaatacgtacagcgccgtcaaaaactggtctgcttcatttgtgtcgattatctcattttcctctgcgatagagttgaaatatattcgcttgacggacagacggactatgctgtcctcctcctcatttactatcttgaagtctgtcggcgcatcactcttggtgagaagctctctggtcactgtcggaaaaagtgtcgtgatggatttgtgatattttttatccactcccatgagctctgcgaatttgtcatttacccagagtatcttgccggagtattcaagcagggcatacggcacctcaaactcattaagcagcctcttctgcaccgatgaatactgtgttgcaaagcttatcagctcatttgcaacgactgacttgcttctgacatacaaaaacagcacgagcgcaaagtaaaacactgtaaagcctaccatgccatagccaagccttctgtcatagcgcagtgctattccgtcagcacatatccacacaaacgtcagatatagcggccagcacatgtagcttttcagcctgcccttgaattttatttttttcttcattttactctccttatccccggtacgttgcgctgatgctgccggtgcaacggttgcggtttcgagaatgtactacaaattaatagttaccggccacacctttgtgcaacccgtatcgattgatatacctactagagagtataccactttgtgaggattattcctagtactatatttatcagttatactcaaatcgttgctgttcacactgttaggtgtgaaccgtaacttatactcagttatgattatgaggaatatatggcatttctgtgtagcagagagaatcttaatacaattctgtgcaatctaaaaagcaccgcatatatctgatattgatatgatacatgcgatgctttttgtgtgctctcatcttccggtattcattttaatgatatgagggtcaaaaagtattttgcccctcatttatgattacttctcagtcttatccgtagctatctctgcaattgactttgtaagacctgcaatcccctgaatctctgaagggatgattatctttgtagccttgccgtctgctgccttggcaaatgcctctaagctctttatctggagcactgcgttatccggatttgcctccttcaacatgcgaagtccgtctgcattggcctgctgtatcttgaggatagcctctgcctgacctgctgcctcctggattgttgcctccttctttgcctctgcgcgaaggatggctgcctgcttttcagcctcggcatcgaggatgactgactctttatttccctctgcaacaaggattgttgattttttctcaccctctgcacgaagaatggcctctcgtctctcacgctctgccttcatctgcttctccatggcatcctggatggcctttggaggtatgatgttcttgagctcgacacggtttaccttaatgccccatggatctgttgccacatcgagtgttgcgcgcatcttggtgttgattgtctcacggctggtgagtgtctcatcaagctctaagtctccgataatgttacgaagtgttgtggctgtgaggttctcaattgccatgattggattctctactccgtatgcgtaaagctttggatctgtaatctggaaatatactacagtgtctatctgcattgttacattatcctttgtgattacaggctgtggcgggaaatctaccacctgctcctttaagatgactttctttgctattctgtcgataaatggcaccttgaggtgaagtcctacgctccatgtggtgagatatcctcctaaacgctcaattaccattgcatgtgcctgtggcacgattttgatgcagtttaccagtactataagtacgattacgagtaacactgcaagtgctattaatccttccatttccggttaagcctcctttaccctttttacaattagttttactccgcttatctttactacctcgataagctcgccttttcttatgacctgggtctcgtcctgcggtctgactgtccactcctgaccgtttacaacggcttttcccgtctgcttcatgctgtcagcatcctcggtgagcacagctctttctccgaccagactgtccacgtttgtcttcactgtcctggaattgatgtacttcccggcccatggctttgtgagagctaaaagcacgactgaaacgagtataaatgcaattccctgtaccacgacattgccgccaagcagtgcggttataaacgctataaatgagcctgccgcaaaccatatggatgtgagcccgactgtcataagctcaactaaaacaaaaactacggtagctgccaaccagaaaacaatgtatgtatccatttgaaccctccctttttattagtatttgttttatattcattttatactatgtaatttgattatgcaacaaatattaattttttaaacataaaacatttttaacctaaaaaatcccggccaccatccggtagtcgggatttatcatacatttatcttattcgcaaacgtatggcataagagcaagatgacgtgctctcttgattgctactgtaagagctctctggtgctttgcacagtttcctgtgatacgacgtggaaggatttttcctctctcagagatgtatctctttaatttgtttgtatctttgtaatcaatgacattgtcttttccacagaatacgcagactttttttcttctacgcattggtcttctcttcattgatgaaccatcagctgatttattgtaagccatttttgttacctccttgaatatttttcctcgtggacactactaattgaatggaagctcctcgtcgattccgtccggaatgttcatgaagccatcacctgcagcctggctaggtgcaggtctgtctgccggtgcaaatccgcctgcatttcctgatgcggctgatttggactctgcaaactctgcattctcaaccacgacgtcagtggtgtataccttctgtccgtccttgtttgtatagctgccggtctggattcggccttcaacaacaaattttgttcctttacggccaaatctctcaaaaaattctgctatctttccaaaagctacgcagttgatgaaatccgttgactgctcctctgcattcttgctgtagcgtctgtctactgcaagtgaaaatcttgctattgcaagtgagttgtccccctgggcatagcggatttctgcgtctctggttaatctacccataagtattactttgttcataatacaatctcctattttcttatactatgcctcgtcttttctaacgcataagaaacgaagaacattgtccatgatacgaacgtcctgctcgatttctgctgggactgttccctcagcatcgaactggatgaagtaataaaaggcctcagtcatgtgctgaatctcgtaagctaatctcttcttaccagcctcctcaacttctgtaacagtaccgccggcacgtgtgatgtactcttttgccttctcgactactgctgttctcgcatcatcctcgatctttgcactaacgacgagtgctaattcatatttgttcatgcgaatgttacctccttttggtctctggctcataaatctgattatgagcaaggaattttatatcacgagtctagataataacatgaatcgtggtacttttcaaggggtttttgcaatttttcttttatttttattaagtcgggacatgcgccgcgggcagggggcgcacgtcccttactctgtggctgaatataaaataaaaagacgaggtgcagtaaactgcacctctgtttttattcctctgttttgttgttctgctttgtttctattactcaagcctgcttcttggtgagaccgcggtcatttttctcgaccagcttccttggcaccataacctggtgtccgcaacccatgcatttcaggcggaagtctgctccgacacgcatgatttcccactcgctacagccgcacggatgcggttttttcagttttacgatatctcctactgcgtatttatccattctatattcctcttctacctatgcctgccatttaatatgctgtgtattatcctctgtttacacctctatctgctcaaatacagagcccagtccctgctgtatcagaaggtctgctcttgcgtccatcggtgtggtggacttgttgataagcacgagcttgtttccgttgtaatagtctatgaggcctgccgccggatataccgcaagtgatgtaccgcctactatgagcacatcggcgtgactgatgtagtagattgcatcctcaagcgttttctgatttaagccctcctcgtacaatacgacatccggctttaccgggccgccgcactttgggcattttggcacgtctgttgagtggaggatttcctctgcgcttacaaactgcaagcacctctcacagtagtttctcagcacactgccatgcagctccattacatttttgctgccggccttctgatgcagtccatctatgttctgcgtcacaacacccttaagctttccggctttttcaagctctgccagcttgtaatgcgtgatgttcggccctgcatcaaggcagagcatcttgtcacggtagaatcggtaaaactcctgcggatgcttcctgtaaaatgtatggctcaggatggtctcgggcggataatcatacttctgattataaagtccgtccacacttctgaaatcaggtatgccactctcggttgatacacctgctccgccgaaaaatacaatattgtccgaagcctttatccactgcaaaaatgtttctacactgctgtcattgttacccatatgtatccatcctttcttctttaaattgctgcctattattttttgagccacacttttatagctttcgcaccagcttgtccacatctgcattcagtccaagcaccatcactgcatcgtctgccttgaacacgtagtccggcagcggaagcacgcgattctttccggcttcctttactgtaacgatatttacattgtatttctggcgcacattattttccttgatgctctttcctacccagccttcaggtggatttatctcgtagattgagtaatcatcgtttaatgccacataatcaagcacatggttggcgctgtatttctttgccactctctctgccatgtcgcggtcagggtagataacctcatccgcaccgtttcgaagcaggaacttggcatgcacatccctgtttgccttgctgatgacgtattttccgcccatctccttcacgagacttgttatctcaagcgagctctggaaattggtgccgatgcatacaaaaatcaaatcgaaattgttgattccgagtgcttttactacctgtgggtcggtacagtcacctatctgcaccttggtcacgtcatagattaaatccctgaccttggcctcgtccttgtccatcaccataatgtcatttccgttttttatcaaatccgcacacagatggtgtccgaatttacccattccaataattaaaattgatttcattgcgtttctccttatccttatcctatgataactttttcctccggaagctctatattggctttatccggtctatgcacaaacgaaagcacaaaggtcatgcttccgattcttccacaatacatcataattatgataattatgcgtcctactgtatttaaatctcttgtgatgcctgttgtcatgccgaccgtactgattgcagagtatacctcgaacagtacatcgtccatcttcatattggatgtggcaagtatagctatcaccgctgtaaggccaagcaccagattgatgataagcaccattccggcctttttgattacctcactgcttattttcctgccaaacacattgcagccgttgcttcctctcatataagaaacaatatagattatcatgaccgccatggttgtggttttgattccgccggctgtcgagcccgggcttcctcctatgaacatgagcactatagtcaaaagcttgctctcctgtgtcagtgctgctgtgtctactgtattgaagcctgccgttctcgccgtaaccgagccgaataacgatgcaaatatggcacccggtgtatccatgcctgctatggtattgtttttttcaaaaatatacataaacagtccgccgccgaagacaagtatcagtgtggttgatattactatcttggcgtggagcgagtatctgctaaacttaagctttttgattctgacctcattccatatggtaaaaccgataccacctatgatgataagcagcataattgtgatattgactaacggatctgcggcatattttgtaaacgatgagtactcctcgtttatgcccatcaaatcaaagcccgcattgcaaaatgcagatatcgagtggaacaccgagaaatatatgcctcttaatatgccaaagtccggtatgaagcggattgctaaaagcaccgctcctatgccttcgataaggaaggttccccttattatcacgctgaaaagcctaactattccaccaatctcgagtgcattgacgctctcctgcatcaaatccctctgtctgagtccgatttttttgtgcagaagcatggaaaatgccacaccgattgagatgaagcccatgcctcctatctggatcagcaccagaattacaagctgccctatgatactccagtgtctgaaggtgtcaaacacaacaagacctgtcacacaggttgcgcttgttgccgtaaaaagtgagtccaggaaattagtccattgtccgtctcttgaagaaaacggaaggctcagcattattgcccctgataatattgtcagaaaaaagccaactgcgatgtatctgaactctgtcaggttcttatgtcttttttttatgtcatgttttatatcgttcatatccaatcctaactatttgctgcagaatgtattattgtcagcttacagaagctgtttgtatatatccctcttgctgacacctctgtcctttgccacgagcttcatggcttccttcctgtcgatgccctgtgactcatagtgtgccatatgctcttcaagaggcatggcttcccagctttcctgctgctcctttgcaatttcagccacgtttctgccacaaattacaagcacatattcgcctcttggctcctgtgtccttgaacgctccaaaagctccgaaaatgtagtctgcaccttttcctcgtgctttttcgtaagctccctgcacacggtgagttctctgtctccgagcgcattgtaaagctccgtgaccgtctttataagatgatgaggcgcctcgtagattatgattgtccgggtctcttttttaagctcctcaatgacgcgcgcgcgttcctttttatccctcggcaaaaatgcctcaaacgcaaacctcctggtcggcctgcccgacatggtgagcgctgtaatgcacgctgctgccccgggaagtgaggtaacaggcacgccctcctcgtagcagatgcgcactatgtcctcacccgggtcagaaatgccgggggttccggcatcggtgatgagggcaatatttttgccctccttaagctttgccacaagctggtaggctttatctatcttgttgaactcatgatagctcgtcatgggtgtctttatctcaaaatgattgagcagctttatggagtttctcgtatcctccgctgcgatgaggtctacctccttaagtgtgcgcagcacacggaatgtgatgtcctccagatttcctatcggagttgcgcacagatacagtgttcctgtcatatgattctcctgttattttccgttattccggggcttatcgccgtatatctcatatatctcatccgtgtatacattaggctccttgtatacaactaacggtttttcgatggttatacggcttttgccgccctttagcccctctatgagcaccatgtttggctccctgtccgcgtagggatgtacaaggcgcatgcgctttggctcgatatgatatttcatcatcgtgctaaagatctctgccagcctgaatggtctgtgaaccatgtaaaaacgcccgttgaatttgagcatttttgcgctctccctgactatatcgtcaagtgtgcacctgacctcgtggcgtgctattgtcatggcatcgtctgcatttttaataccgtgctgacctatcatatacggcggatttaccgtcaccacctccacggactctcgaccgaaaatctccgatgcattgcacacatctccctcttctatggtcactttgtcctcaagatggttatatttcacacttcttctcgccaggtcagcacactgaggctgaagctcaagcccgctgtaatgctctccgttattctttgcctcaagaagtatcggaatcacaccgtttccggtgcacaaatccacagctctctcgccgcgctttacctttgcatagtcagataaaagcacggcgtctatgccgaagcagaacagctttggatcctgtatgagcctatagcccttgcggcacaaatcgtctagtcgctcattactgtgtatcagtgcttccattgtctttgtccctgttgtaatctttactatactctttgttatagtttttgttcttgtaatccttgttgcggttgtatttctgcttgtttggtctgtttttgccgcccttgtacggctttttataaccgtccttattttctctgccggcatttgtggcatttacttcatttgtctcatttgcagaagcttccgctgcctctatgcccgccctgtacggacgtctttctctgttgtcacgcttatcacggcgctcgcgatattcatttttgttatcacggtgtccacggtttctctgcggtttctcctgtgacttgtcctccatcgtctcgtcgccgctatcctcgagatccttgagctcgcgaagctcctcctcggtgagctttacatcctttttctggcgcggctttaagcgcagatcatctacagtgtactcacgaagctccttctcctcgccgttgtcaatgacaacacgcacgagctgcctgagcacgctgactgacttgacctctccgatgattccctcaggtgtctttaccttttctcctaccgacggcattctgctgttcagatactcatatgtatcctgctcatacttgagacagcacataagccttccgcacacaccggatatcttggttggattgagcgagagattctgctcctttgccatcttgatggaaaccggcacaaaatccgccatataagaatgacagcagagcggtctgccgcatattccaatgcctcccatcatcttggtctcatccctgacaccgatctgacgaagctcgattctcgtgcggaataccgctgccagatcctttacgagctccctgaagtcaattctgccgtccgctgtaaagtaaaacaacagcttgtttccatcaaaggtatactctgcatccaccagcttcatttcaagtccgtgcttgatgattttctccttgcagatggcaaatgcctctttttccttttccttatttctctcaaccgttttctcatcctcgtcggttgccactctgatgacaggcttaagcggtgaaaccacctgatcatcatccacctccttcggcggaatgaggacagttcccatctctatgcctcttgctgtctccacgataacatgcattgccatgtcgaggtcgaaatcagccgggtcaaagtaatatattttgcctgctgtcctgaatctgataccaactatttttgtcatgtgattagttctcctttatggtcataagcagcagctcaattaccaggtcaaaattgacgtttgcgttaattcttatcttcgccttctcaagtgcctcaagtattgcctcgattccatgataggaatgctttgctgcctgtttctttatatcatagacctcatccttgaatatgagtccgttaacatcgtttgtcgccttcatatacagcacatctctgtaccacaccataatcaggtcaaaataatcctgcaccttaagcttatactcagctatctgctttaccgctgcacccagctcgtagagatctatgtcatcgaggcgctttataagcgacagtgctgactcctttagctcgttgaactcgtctgatgaggcgagcttaacagcctttccgacgatgccctgtgcaaatgcggcactgatatctgcctgataatccggaatatgcttttcgttcatcaggtatgcctttatcacctcgtcctttaccgacttcatattgagtgtgatgcagcgcgacctgatggtctgcagaaagctgtctgcattggtggtgagaagcatgatgaccgcatatgccggtggctcctcaatggtctttaaaagcgcgttctgcgcctgctgattcattttttcagcctcatccactatgtaaatcttatatttactgctgtacggctttatcactatatcgttgttgagctgtgtcctgatgtcgtcaaccgatatgttgttgggcttttcatgactgacatatatgatatcaggatgattgtggtcatctgcctgatggcacgatttgcactctccacaaccgtctgtgccctccttctcacactgcagtgccctggcaaatgcctcggctatcatcattttgccggacagctgtggtccgtttattatatatgcatgtgagacctttcccattgatatggcattttgcagatgctctattatctgctcatttcctactatatccttaaatcctgccatagctgctgcctccgttttagtctgcctgtgtctgttatagcttttatctcctacgtgaatatatcaagcaacagtccacgtatctctccgattctcgccagtatggacagatgatccttctcatcctccaccagctctgatgccagctcatccagattgctgtctatcagtcttattataccataaactctgtgccttcctctcctgtcgaggaaattttctctggaaaatttatgtgatctgtagaccacctcatttaaaaaatcctttatgagcccgcgatatcgcttcatatccctgatatccatatgctcggctattctgttgccctgtgctgtgatatcctgcatcagcgcatctacctttgcctggagatcagcgtctgttatggcgctggccagtgtgaatttgaacgagccgtcaccggcctgtgttttttgtgcatcaggaacctgtgtcacctgatttacttcatttactctgactgccataaggctgcctccttattcgtttccggttacatttatgtgcaggtcgtaaccatcatcttgctctgcaattaggaactctgtcgtatgtatgctgaaatctcggcaagcacagtgtccatatcatcatttacgaaacggtgtgtaatacccgcctcatgcagcttctcctcagagaaatctgatgcgtctgccagaaaacggcggcacatctcctcatatttaggcacctgctgccctttttcccggtgaatggcgcgtatcagacggtcgccgtcctccacctccacatagattggcagtaccttgtcactgccaaaataatcgcgtatctttgtgtaagactcgagtgttccgactgtcagatagcttttgcagcgaaggtctatatcatcatcgtttaccgtgaaatacttccacacgccgtacactgtattgtactctcgaagctctatgatgcgcccctgtgcactgagcctttttacatcctcttcattgcagaaatgataatccttatcctgtgtctctccgtcccttatcgggcgagtggtatacgggataatcctgctaagcatgagggaatcatcctgcagtattttgttgtatatagtgtccttgcctgatgcgctttttcccatcacgcagaaaatcttacccatctgtaaacctcttaatattgtaattagtataaatatgattgtttgctatgtcaaactgttgcttacagcaccgcaacaaacttccacatattggcatccggatcaaaatacaggccatccacttcaagacctgaatttacagcctttattacatcatctatgagcttgtcgttcattatctctcccggcaccacaagcggtatccccggcggatatatatttataaaggcaccgctcaccttcccgcttgccttaaaggcatagaccgcctgatggtctgcatcatatgcatcatacatttccattacggcaggcagcttttgatatatatctgtgtccattttgacaggcaggtaaaatttatgtattacgccctcctgctttaatatatcataaaactcttcaaaatcagacttatatttttcgagctggctgtctatttcaatcaaagcatccgcaagcctgtcaaagccctcatccgtatccatgacagacgccagcgccagtacataattgcccgccgccatctcaagctgcagctcatattttttgagcagaagctcaagcagcgtatgtccattcatagcctctttcgtaaatataataatctttgactcgtcaaaatcatatgcctcatcggcagaaaaatcactttttctgaccacgttcagatgcaaaagtccactgaccttctgataaaatctgtcaagtctgctcctaagctgtgtaaaggctgtctctttattatcgcgcacatagtgtatgcagcgctctatgccagtcataagcacatatgacggtgagcttgtctcataaatgccgagaaacttctccactgctccttcacgcatcccaccaagcagcaaaagcgctgtctgtgtaaatgccggaagcgtcttgtgcaggctcactatgaccgcatctgccccgagtgcaatggcattctgagggaagccgcctccaaagccaaagtgcgcgccgtgtgcctcgtcaactatgagtaaagctccatgtgcatgtgccacagatgcgattgccgccacatcggaaaccacgccatcgtatgtaggcgaagttatcacgaccgcccttatgtctggattttcatcgaatgccgcccttatctgcgcctcggttatctgcccctgcagccctgtccgtgtaatttcagggtatgtaaacaccgggtgaagctgccttaagtaaagcgcatgatacaccgccttgtgacagttccttgctacaagcaccttgtctcccctttttgtggccgcagatattgctgccaatataccgcaggtgcttccgtttatgagaaaatatgcacgctttgcaccgtaaagtgccgctgcctcagcctgcgcctcctttataatgccctcagcgtggtgcagattgtcaaaattgtctatctccgtgatatcaatagcatacgggtccagccctgcacctatatcactgccacggcgcttatgccccggcatgtgaaacggataaatatttgattgtgaattatttatcagttctttttccatttaagtacctatatatcctttttagccaagaaatcttccaagctccggcatccagtcatcataaaatatttcatcattgcagaacgcgctccagaccggtgtgaggaaatcaagtatcaaatcaagtgtctcctcccagcctgcattcgcatatgccatctgctgtcgtgtcagcctcttacaataccgctcccagcgccttctcatataagcatagctgcgatagccatacacctgctcaagccggtgcatgctcactgtcttcggcttatttttcgctctaaccttaaaaatatcaattatctgccttccgctgaccgaatatctcttaagtatctcatatgcatcaccatatggtttcatatcgctaaccagctcaagcttatccattatctcaaacagctgttctccgagcctggattcaggcgaaaaaatacaaacatctgcgtctccataaaagctgttcataaaaacaatatttttagtcatgggaactcccgcatccgcttcattaaggcgctcaagcctcactgcaaacggtacttccccgccatcacacatagcgcttagattccacgtgtgtatcagcggctgcatatcactggcgtccggttcattagctgatacctttgccgcctgcttagataattctgcattagtccataccacatcactgtgactgttaagccctgcattgcctataatgatattgcgcagtacatcaaacggtgtaccattatcctctgccctgccaccggggctgccatatacataataaaacgccagcttttctcctgttgcaaaatacggcttttgaagccacagcacatttcccagaccggcattatttatgcgccagagaaaatcctgcttcacgtactgccataacacatcgctgtacgataattttttctcatcgcttatatgtcttaaatctaccctcactacaaccatactcctatgaagctttgcaccttctttaccacgcgcctcgcccttgcgtaatccatgagcacggaaatatccttgtccgtatccgctatgtatgactgtacagctgccttgaaatcattgcggtccagtctcgactcatacttcaggcagtcgcatatcacacgttctttatcatagattccaaaggtattgcctccaagctcaatggttgtggctccaagcataagtgctgtgggctccgtataaaacggaatgattctgggatagtccatcttaaaacgcgattttgatgtgtttttgtccacggcaagcgtccatccgtatggcttctcctttatatagccataggcgtaaagtgcactttccatgcaaagcattgcatccggaaagagtgccgcgacaagtgcatcctcagaaaaatcatccacgcggtcggtgtaatagccgtttctgatgcggacaagcttcccctccctgacaagcgtatcgattcgcctgtagtctataccaagccttgtaagctcttcttttttcactattccgttgtacttttccatggcatcagctatgatagtctgtacctgttgtatattcattactgcttctccatcccttgcttatcggctaaaagcctcttggcatcacgtaatccaagctgatacaggctctcaagcttcttggggtccttttctaccttgcttattttaatgtgctccgacggccttaacacctcggcaatgccctgcttttcaagctccttaagatgctcaagctgataattgtacatgatatgcctgtttgaaaatgcctcataaaacctcggaaaacgctttttgtataccgatgttaaaaaccttggcataggtttttttatatagtctgccggctttgtcagcacgacaaccactctgtcatatcccatatcaagcatatgctcatatggaatactgtccgtcaccgcgccatccagataccactcattccccagcttcacaggctttgacactacaggcatggagcccgatgccctgagcacatccatctggtcaaagacactctttatctgcacatattcaggcttacctgtcctgatattcgtcacaaccgcataaaatgggatatccgacttcttatattcttcatcatcaaacgggtcaagctctcttggtacggtatcataggcatatttcgtgctcactatatttttctccctaagaagcggcctgatacccatataatttttgtcactgttaaacctcttattgtatcgtataaccctgccgcgctgctttgacagcagattcactccaaaaagtgctcccgccgaaacaccgataacagcatcaaagctaatatcatggtccataaaacagtcgagtactccggctgtatacatacctctcatggctccaccctcaagcacgagggcgcatctttcatcactcatttctgcctccatttataatgtcataataaaaaatgtattaatatttatgtcgaccgctgaacttcagattgtctctccttctgcgctgttttctctcaagcttgtgctccctgaagcgctcgcgctgctccttcttaatgctccatttgtgtttcaacacatatatattgtctgatattcttctaatcatgaaaatgctcagaagaatcactgagataagtatgagcacccagagaaaatataccggctttatccttattatatcactttccacgttctgtctgctgttctcatcaaagtacgacagatcgacctttgctcctgatttcagcagatccacacagcctaccacatgatcaccatacttgtatctgaccgtagcaagagcatccttgttgtcggacttcatgtcagcagcttcccttttaacgcttgaaaaatccgcgttgtttggcaaaacaacatagttttccgatacctttgcatacatgccgtgctcattcatcacgcccagatccggcgtattgtcagtagctgcgctgttttcattttcagctatgcttagtgccttgaagttactgaaacagtaattgagcagcgtgtttgtgtctgcatactggtcaggcgactgcgcattcataataaccgtgcacagcgtcaagccatccttctccgcataagtgacaagcgtgctgttagccactgaagtgtagccggtctttccgccggtacaatcctgatttacaaactgtgaatacgacttaaatggatgcagcatcgcatgatgattgtacagcggggtatcctcggtatgcttgtttgttggtggtatgatataggtctttgtgcctgtaatctttcgaaactcgtcattcctgtatgccgcacacgagataagccccatatcgtatgcgcttgtccagtgattttcatcgggcagaccatttgcattgttgaaatgtgtatctgtacagcctaattcttcggcttccttgttcatcagatcaataaatgtgctgtaatctcccccaagctttttgcctgtatgctctgctgcagcatatgcgcactcgtttgccgactcaagcataactccatatagtgtctgctccatggtcatctcctcgcccacatccctcttgatgctcgacgaaccatcactgctctccttcaccgcctcttttgagaatgtaaccttctcatccatcttgcagttgagtatagtcagatatgtggtgagaatctttgtgatacttgcaggataatgcttttcgtgtgaatttttctcatagagcaccgtacctgtattgacctccatcaccacggcgcacggtgaatttatctgcggtccctccggccagtacgtgttatcaccatccgcaaatgccataagcggtctcgcacaaagcgttgtgaccatagcaaacactgccattattagtattcctgatttttttaaatttataattttatgcttcatatctgttcctattaattctaaaattgggtagctgttcagtactataaccaaaaatgtactatttctaattataatgtatgaaaaacatgttatcaagggcatgtgcatcgtatttttccattttattttgacacccacacaattgtggggtattatctatatgaaattttacgtttttataaggagatttacatgagacttagaaatatcccgggcgccggtgaagtcatcgacaacagcccttattgcataaaggagcctgttgaattaaaaggaaaatggcatgattttttaggaaacaataatccgattcatatagaggttggtatgggaaagggcagatttctgatagatctggcacggcttcatcccgagattaactatataggtatcgaacgatataccagtgtgcttcttcgtgccgtacaaaaaatgcaggaggacgagctgccaaatgtgcactttttgtgcattgatgccgcaactcttccggatatttttgaccgtaatgaggttgaccgcatttacctgaacttttccgatccatggccgaaggacaggcacgcaagaagacgcctcacctcaagcgaatttcttgccagatatgatttgtttctcgcacctgacggacgcatagagttcaagactgacaaccaggacctcttcaccttctctctggaagagattgaaagctctgataaatggcacctcgacgccagtacacgcgacctgcatcatgatgccgcaatgaatgagggcaacatcatgaccgagtacgaggagaaattctctgctgtcggaaaccctatctgcaagctgattgcttcaagataatgcgacatatctgtcgttaatcgcatgatttatatagtcaaacatgacccagcttttatgacattcttcagatttttctgaggaactgtcatattcgtctctggcatcattgaaatatctctgcgcttccttatctcttcccatcttgctatagcttgaaccgatattgctgtaaaccatagccttaagatctctcgagcggataatttctgccgtggcaaggctctccagataacattcaaaggcttttgactcatcgttctcaagctcatataccaatcccaggatattgagatactctgcatatttttccacgtgaccggtgctcttcaagcgcgcaagcgctttctttatgcgtacaaccgcactatcatagtccttctttaccacgtcatctactgcaattatcatttcgttatccgctatattgtctgttgaatatttgtctaccgcgttcatcatattttactccgaccaaagcatctttccaaatgttacttttttcctattcaacagtataaactcattatttcaaaatttcaatattaatttcacttttatgtgcctgagctgccagcctatccaaataatgacatgataccttttgatcctttaaccatgatataatgagcgtagcgaattatatcacgcgcgaatgcgcataagtatcagccgcaggcctatcatatgcgtaagcatatgatataatgagtgcaagtgagaagaatgcatttatgcattcggcgaacgacgaatgttgatcatgaagcaaggcttcatgatataataaaaaagcaccaaccctatggctcatacgtccataaaaccggtacctttgagtgcgcctccaggggctcgaaccctgcacaccctgattaagagtcaggtgctctaccaaatgagctagaagcgcgtttattaatttgtttgcgttttccttaacgcgaaatttattatatagtatagtttatagaaatgcaacacttttttttaatttttttaaattttttttagattttttgtaaaacagttgattttacaccgttttaagctatattattttctatatacagagactttttattccagatttcccatccaaagtctctcagaaaggatttactgataatgaaagtagaagaaagattattaaaatatgtgggctatcacaccacatctgatgaagcaagtgataaaataccaagcagtgacagggaatttgcactcgcaagagagcttgagtcagagcttaaggagcttggcttatccaaggttgtgctcactgaccattgttacgtgtatggtctgctgcctgccactgccggcatggagcacaaaaaagcggtcggatttattgcacatatggatactgcacctgatttttccggggaaaatgtcaagccacagctgctgcatcactatgacggaagcgatgtgctgcttagaggcagtggcgaatacctgagagtaagcgattttcctgagcttaaatctctcaccggacgcactctcattaccacagatggcactaccctgcttggtgccgatgacaaggccggtgtggctgagattatgaccgccttagagcagattatcgcagagggcactcctcacggcgatatctgggttggatttacccccgatgaggaggtcggaaagggtgcggatttgtttgatctggactatttcgaggcagattttgcctacaccgtggacggtgattacgagggcgaggtggcctatgaaaactttaatgccgcaagcgctgaatttaccataaagggcgtcaacgtgcatccgggcgaagcaaaggacattatggtcaatgctgctttggttggctgcgagattgccgcagcgctgcctgcaaacgagactcctgccacaactgagggcagagagggcttttaccatctgtgtgatatgagcggtgatgtagcatcagcccatctgtcatatattgtgcgcgaccacaacaaggctctttttgctaaaagacttgatactctccgctctcttgagatagagatgaacaaaaaatatggtgagggcactgtttctttgactatcacccactcctacgagaatatgctttcaatcataatggacaacatgtacattatcgacctggctaaggctgctatagaggaaaacggtctagagccgctatcacgcccggttcgcggcggtacagacggcgcacgtttatccttcatgggacttccttgtccaaacctcggtaccggcggctacggcttccacggcccatttgagcacatatcagtggagggcatggagactgcggttaatataatcaaatcaattgtgaagcatgtgctgatgctggctgacgtgtgatttcgtgccggtcagttactcttcacaactaacagtgtgactagccacggccacgttactgttcactactaacagtgtaaccagtaatctgactgcgttttagtgtaaacaataactgatttgtgtattgacttatctgacaattctgctataatgatggcaaccaattgtttttcgtttattttcgaacgaataattacagctttttttgaaactgacagatgtttcagaagggagaccatatggtagtacttgcagcacttatcatttttgcagttgttggtggaatatttgtaaattatcttcgcagaaatcaaaatgatatcggcggaggaatgggaaagaattacatgaaagagcattggggaatcgatgacgacaagtaatcaaaaataccgggcaacacattttgtgtcccggtattttttatacaaccatcgtaactattcagaaccactgagaacaaaaaagctgatgcgtcatcagaaaagcctgactttgctatcgtgaatttgcaggctccatgttcacagagcggccctttatcttcgcattcttcatggcattaagcacttccttgccatactcagccggcacctcaacaaatgtatacttgtcgtacatgtcgattgcaccaacaagcctgccaggcatgcctgactcgcctgcaatggcacctaaaatgtcacccggctttatcttgtccttctttccgacgttgataaacaggcgtaccatgccatcctctgctcctgtattgtggaaatcatagtcgtcctttgattcagctgtggatatctctgaagcacccatagcctggtataaaaatgccgccgctatatccattgccgtgtaatctgactcatttatctgattctctataatatcaatgacacttgtgagattttcctcatctataatggtggaaatctggtccataatcttttctgccctgattttggcaacatcatcagatgatggaattggctgtgcatagatttttgtcttgcagtagcgctgtatgtccttgagcttatatacctccttgccctttacaaaggagaatgcctttccacagcggcctgctcttcctgtacggccgattctatgtacataatactcgtcatcctgaggcagatcataattaaaaacagcctccacatcatccacatcaattccgcgcgctgcgacatcagtggcaataagaatatctgtctttccgtttctgaagttcttcatgacacgatctctctgcacctgcttcatatcaccatgaagtccttctgcactgtagccgcgtccgcaaagctcatatgccagctcgtcgaccatcttcttggtattgcagaatacaagtgagagctttggattatagtaatccaacagtcttgtgagtacatctatcttgtccttgcgcttcacatcatagtaatactggtcgatatttgcgactgtcagctcttttttcacaatcttgatattgatagcatcatgctgatattttcttgtaatttccaaaataggctttggcattgttgccgagaagagtactgtctgatgctcctgtggcaggtattcgagcactgtctcgatatcctccctaaagcccatgttgagcatctcgtctgcctcgtcgagcactattgtctttacatggtcaggcctgattgtctttctcctgagatgatccataagacgccccggggttccgataataatctgcacaccgcccttaagtgccttaatctggcggctgatatcctgtcctccgtataccggaagtaccttcacaccatgcatatattttgcaagcttcctgatttcatctgccacctggatggcaagctcccttgtaggagagaggatgataacctgtgtcttgtgacttgatgcatcaacgctctcaagcaccggaataccaaaggctgctgtctttcctgttccggtctgcgcctgtccgattacatccctgcccgaaagcactgccgggattccctgagcctgtattggagttgcctcctcaaagcccatatccttgatgcctcgcaaaatcttagggtttagttctaattcgtcaaatctgattgtttccatatattttttatatttcctttcaaaaaaataaagtgtgcatatttttataacatgcacactttaacatatttgtgagataattacaaaatattatttcttcattttttacgaaatatgcggtaccgcatatttctttactgaatagttaccaaaatactacatactgctaaataaagctgctatctcatccggtgtcagattacgatttgtgttattcaaatctacaaccggagactttgccggttccggttcacttacagcctccggctcaggtgcctgaggtgcatctgtgaccggttccgtaatcactttctctgccggctctgattcaggttctgtcgcacctgcgtttgcacttgcaaaaagtgctgctatttcatctgcactcaactggcggttcggatcgctgtttgtcgtatctgcaacagcttcggctgcagcagggcttggctctactaccggttcaggttcaggtacatgtggtgcctctgtgaccggttccgtaatcactttctccgtcggctctgattcaggttctgtcgcacctgcgtttgcacttgcaaaaagtgctgctatttcatctgcactcagctggcggttcggatcgctgtctgtcgtatctgcaacagcttcggctgcagcagggcttggctctactaccggttcaggttcaggtacatgtggtgtctcacttacaggttccggttcatgtacatgtgatgtctcaactacaggctccggctcatttatctgaataggctcaggtatctgttctgactcattcgcttgtacagattccggttcaggtatcgcctccatggccgatgctgattgtggtgcgtcggtcgtttgcttaggcatctcaacatttgctgtaaactgaataggatttgctgtgattgcctgactcagacggatttccatatcctttatgctgtcagacagaacctgctgcttttccataatgtccttgaggttatcataaatcacatttttctggctctcaataatgaaatcattgctctccttgagcttattctcaagacgctcaaacgtctccataagctgttcattagagttcataatcgcatcagcattttccttattcctgttgatgacaacctttgcaattcccttctgtgcattgacgatatcctcagtcggaatctttgactccttctgcagtatctcaatcttttcctctatctcatcaaaatacttcctaagcatgaggtaagatgccttttcagacttgaaaatactgtcatactgttcctccctcctgtcctcctttagagcacttagtgagaaaaatccgcttatcactccccacaggcaaatcataaagataactgtgattgctgcaatgagcatgtattcctttggataattaattatcgcataaaaatccgctaaaataacaagcgtggaaataagaattagaaatataacctgtatttttgcctttttttgctttttatcctgcatataattccccttcccggggcctgacgctatccgcgacagccgtaccgtgtgatggctgtggataatacaagtcccagtacatttatcttaatgtatctattatagcgtttattggctgtaatgtcgattgtttttaatgattttcagacattttccaagtatccatgttttccgaatagcgtacgtatataccgatgttagtattttttttcattactccccgataattgtaaacctttattgcagtttcggttgacaatcgacatcttttcatgttaatgtgttaaccgtacaaaaattactatgaaatttacaaaaaggagattttatcatgaaccagacagaaactatagactacaagcatggaacgacctatgccataacggtaacagcgctcatgacagctgtcacatgtattcttgcaccattatctatcccgattgggccggtaccgatttcactgacaaacctggccatatatatttcattatatctgctcggatggaaacgtggaactataagctacctcatttacctgcttatcggacttgtcggaatccctgtattttcaggcttcaccggtggcccagctaagcttgccggccctacaggcggatacatcatcggttttattgccatggcaattattgcaggacttgtaatcgatcatttccaccagccttggctccagctcattggtatgattgtcggaactatcatatgctatgtgctcggtacagcatggttctgctttgaggcaaaaagcacagtcagcggtgcgctctcaatatgtgtgttcccatttatcccgggcgacctgataaaaatgataattgccatgcttatcggaccggctattaaaaaaagacttcgctaaacatcaactccaagctttctaagctcctgatacaggcgcgctaccggaagccctaccacattattgtaatcaccatgtattcccttaatgtggatggcaaagcgtccctgtatcccgtagcttcctgctttatccatcggatccccgcttgaaatatagcggtcaatttcatcttccgtcagtgtatacatgctgacatccgtcttctcataaaagcagtgttctccggttcttccggctttgtcaataaaaacaaacgttacccctgtatagacactgttcgtttttcccgaaagcatcgaaagcatacgcctggcatcttcttcgtccttcggctttccaagaatctgattctcataagccactaccgtatccgctccgattacaagaatatcctgcggtgtcacaagctctgcatgctgttcattgtaggtaagcacacctgacgctacctcctctgccttttgacgggatagttccatgacaaccgcagatggctcctcctctgtgattatctcttctccctttgcaggacagacaacaaactctgccccaatctgctctaataattcctttcggcgcggtgatgccgacgccaatattatctgactcatatttgttttaaccttttccttcactttggattttgggactgtttcatctgaagaatacaattccctatgactgattacacgtttccacttgtattatacagctttctctttcaccgatactttcactgacataattctataaaatacagcacaaaataccaacgcaaaaacgactccaaacacattctgaatcaccctgaggctgactgctccctttaacccatagctctctgcagctatagccagagcaccaaatgtattaaaaacagcctgccagccgtattgtgccgataatcccacgccgattccacctatgattcctatgtacgcatagattgatggcggaagcaggaagtataataccgtaaagcatataaccccagcaatattaccgacaatcctttttttgaccctgtactgcatatcctccataaacggcaggatggcagacatggctgcaatacctgcccacattgcacgcggcatattgcaaagctgtgcaatacaaagaactaacggtacacatagtatctggcacagctgccatttcgttcgtgatgaaaaaagatcaaactcctgaattacggctttcatatttcttttaaagactctgtttttatgatttctgtaaaataccaggcatgtaaggacagcacctgcagccatccctgctattcgaagcatatagctttttcctgtcacatcatatccatataacaataaatagccaagaaccagtgtggattgattaaacataaatggattatggcatccgaacaaaatcagcactgcaagagctgcaatgtttataagcagcgccggaagcggtgaaagctgatttgccagatgtgggcatactgtcataattacaaagaacaatgccaaaagccatgtagaatgtcgggtatggattcccagatcagcgtttcgaaataccataacgcataataagaccactactcccacaatgctgttatcctttcccaatatgatgcttgaggcagtgacaaaggtaaagcagaataccattgtgatagctatcttcaccatatatacaaacgcatggtatagtttttctttcattgttttactatttttcagcaggcttttagagccggcctgatttaactgcagttcctgataaaatgtcatatgaattctcctatcttttatcttattatcttattattttattattgtaactatcatgttctaaatagctactcattataattctttattggcagttctactacaaatctgcatcctccgtattcccggttttcagctttgattgttccaccggcgatgtctacaattcttttcacaagtgccagaccaaggccgtttccctcggctttatgagaaccatccacctgataaaacttatcaaatattctggcttttgcatcatccgctattcccggtccctcgtcttccagaataaactgcacagaatcattttcatgccttagaaacatggtgattgtcccattttcaggactaaacttgattgcattatccaaaagattcatccagatatgcataaaaagcccttcatttccaacatatctgacctcctccatctccacctgaaagccaattcctttttcagtccatttgtcttccaatgaaagaaatgcctgacggatttgttcatccagacgatattcggtttttttcattggaatattctgattttccagccttgataacaataaaatatttccaacaaggcctgaaagcctttgagtattaaacaggattttttctacatacccctcctgctcctgtgacagctcatctccctggagcagcatcgtatagccttcaattgcattgattggtgtcttgaattcatgggaaacattggatacaaaatccatttgcaacatctctgttgcacgaagctcttttgtcatgacattaaagctctgataggattctccaatctcggctatgcgactgtttgtttccagatgctgttcaaaacctccctgggaaactgctttcattgctttactgagcctggtaatcggctccagcagccttgcattgataaatgatgtaataagtcctgctatcaatgtattaaaaatcaaaagccagccaaggcccggtattttcccgggcaaatccaaaaaatgattcaaaaacgcaaataacagggctgatatcagcatagaaaatgcaagtgccagccagattgcaccggtcagacatgagcggatacgcaattcttttttctttttatactccattattttttcaccaccttgtatcccagaccacgcattgttacaatttcgaaatccggattttctttaaaacgctccctgattcttcctatatgtacctctatcgtatgtgggtctgcctccgtctcatatccccatacctcatccattagctgctgcttcgtaaatgtcctgcccggtgaagctgccagcttatataaaagcaggaattctttttttggcaggacaagcgtttcatcaccggtcacaactgtcattgcatcataatcaaactcggttgagccaatcacaattttgtgttcgttcagtatctgtgcacgacgaagcagtgctcctaccctcaaaaccatttcattgacatttacgggttttaccatatagtcgtcacttcccgaaagaaagccctgacgcatatcatcgaagctgctttttgcagtaatcataagcaccggtatctgatatcccgccgaacgaagctccgacacaagttcatatccatccataaccggcatcattatatcggaaatgattaaatcaatatattctctgtccaatacctccagtgcctgtgctccatccgacgcacttttgacctgatatccgctcttttcaagcaccttttggaataacagacttaattccttatcatcttctacaattaatatcttaaacacgctttatgttctcctttaatcaaaacaaatcccttgcccatccaagcagatgctgtaccagaaacacctttcttttacgtttttctgttaattcaatcggctttacatgatacggatcataatatgttccgtcgtctaatacctgtctggacacgctctcatactccatcatgccatcctccagctgtttattaatctctttactgcgtattacaagcatcagctctgtatccagataagtacttctcatgtccatattgaatgaacctattactgacagatcatcgtcaatcagaatactttttccatgatacgaataaccgccttcatattcccagatatcaattcctgtttctaaaattctgtttctgtttttggcataatcagcagctccaaatggatttccgttatttgcaacagaatttgtcataatagaaaagtccggaaccttctgtgcaatttcctcccatgtattatacatcatatcattgcaaataatatatggtgtatgaatttttacgcgttcctttgcatttttcattaattctcccagctgataccataccaccggttccttagcttgggtgtggattgggtttgataacaatgtaatcttttctgtttcaaaggtttcatccgcataatctgtatcacaaattttttccttattaacttcaaaatattgctgatacccttcctgcagctctaaaactgctttctttacagactgtctgtcagctaattttttactgttatgaaaataccgacagtcctcctgttcccatattgtttcaaaataattccaaagctgattgaccgaattatctttctgtggctcatcgcagacaactaacacatcccggtcaaaatttttatgccccagaaaatcacccaaaaaataattatatgtgtttcttccgccaagaatatatattttaccatctgcaatcagatatttatcatgcattcttcccattgtcttccatggcttaagcggatttgctttattatacagcttaatctcaacattctcatgcgaagataatccataaaaatatggattaccctccatatcaatccagctctccattccatctaccaatatgcggacatgtacgcctctgtctgccgcatcatgcagtgctcctaaaatcaattttccgctttcgtctgatttaaatgcaaatgtagaaaggattatttcatcctttgcattttggattaatctaactctttctaaaagagcctgcgaatttttttcaatgattactgctctttccgtattctctctccccgccacactcataatattttgtgtttcctttatagtagcatcagacaccgccggctgttttttatatgtgatgcagattccgattaactcataaaaagccacacataaaaaaactgccagtatagccaaaataattttacatattttatgccttttcattgtacatcacctgattccttgtattttatactcatacaatacaatgtcaatctcaattttacctcaacagaattgattttatgcaaaaaaacaggaaaaagcagctgcctgcaatttcctgtccataaaaactcatataaaattattttactgcgatttacctatttttcgtcgcttctaccgtctttccgtttacctgatgtgcaaagctccatgacttcttatagataatccatataatttttaaagcacaattacggcagcgtcaagcccgtctacttttccgtcaaatgcgctatctgtaagcagattatatttcttggcatactcattaaattcctttacactgctgccgcaattgaaaagcattgcgattgtctcatcgccgttttttctgatcataacaatcgtatcatcatcgtcatttgtgattgtctcaatcatttcgccctctacgatgcatgcatgtgcttttctaatctgcatgagcttcttataccaattatacatctccttgtcctggtattcctcatcccagtacatgcctcgtctgcagtccggatcgtttgctcccggcatggcatactcatcgccatagtaaaccataggcattcccggcagtaacagctgaaaggctgctgcgagatgctgttttttcttattatcgttgcacagatgtagaaatcttgctgtatcatggctgtcaatcaggttccacatcagaggatagcactttttgtttaagcgccccttcagatatcccagattctgtacaaactgactgacatttatcttttcatctgcaagcaggtctatcagattcaggtagaatggatagttcattacagtatcccactcatctccctcgaggaagtcgcctgcgtagtgccatatctcaccaattatcagcatatccttctttacagccttgattgcctttctgaaattcttccagaagaaatgactgatttcgtctcctacatccagtctccatccgtcaatatcacattccttaatccagtagcaggcaacatccgtgatgtatttttcaacctcaggatttttcagattaagctttggcattccaccgtaataaccgaagcatttgaagtttggaatttctccccattcacccctaggtggcagctcgtcgataaaataccagtcgagatattttgacttttcgcccttttcaagtatatcctgaaatgcaaaaaattctcttcctgtgtgattgtataccgcatccagcactaccttcatgccacgctcgtgagatttttgtacaagctcctttaaatcctctgttgttccaaatgatgggtcaacctgataataatcaatagtatcatacttatggcatgaatttgatttaaagattggtgtcagatacaccacatcgattcccagatctttaatataatccagatgttctatgattcccctgagattgccatgcaaatcatccataggcgtaatcggcgccttataccacagctctttgtccaccggctgtgttgcggcaaagcgcgacggaaaaatctgatacactaccttgttggctgcccattgtggcacctcaaacatctcttcctctctgagattctgcgggcagtcaaacattctgtccctgtttgtgatgcactccttatcgaactcataattgccgtaatataccttttcaccctgcatgtccgtaaattcaaaaaagtatctcagacatatcagatgcatctgaatctgtgcttcataataatcgtgaaactgtgaggttgctaccttcttcataggaagagtcattcgcgtatccttgcgctccataggtatatacttgtcctcatagtgaaggattacctccttcatatcatccttttttacctgcacgcgtatcacaaacaaatccttatctatcgcatagcagaatcttttatccatgtcatgaaaaattgctgagtattccataaaatgcccctttacttacgtatttcgttattttgtattttaacgcactttttcaaacaattctatcattatatccatgacattttttcactatttctactttatgtgtgattttagcttaataacatttaatttttttgactttattccctaaaacgctgtgttcattatcaatctttgaaatctcacttttgtgccgaaaattcgagtgccttttgttcattttctgctgtcattgcatccacataatcctgaggattccagacttcatctaatatatcctccgggaactttttacgaatatcatcagagtattggctgccatctcccggctcccaatattcagatagttcatatccattctctgtcacattgaaagttagggcaacaggaccacaacctccaccgacactttcaatcccttcttcggacaaattatattcctcataaagagtgagaacatatacggtcaatgtctcattctcctcagagtttgcagccccaccggcttctgtagccaatacagtatggctttcgcaggcaaaaacacctttgtagtatctatcgctgttatgttccatgattgcattatggattgctgtatcaacattggtttcgttaatcgattctgttctggtttccccggcacagatgcgttgtaaatagctgataaagtcagagtcagttattcggtaatacacattctcatacagaattgctgcttgatttccgttggaatcaaaaccgctgaatgtgattctgtcgttttccttggtatccacatgaagggaatagaaaggtgtatgaccttgcaaagattggtctttgtgaccaatctttaagtttttaatacgactgctcaactcgtcaatttccgctgcggataattggaatgtggtcggtccgctatttgttctaaagtccatggtgcttgctttggaaatttgaacagaatcaagtttcactgggaatgaactcggatttgtcaggaaacataccccaagaacaatacttgaaaccacagcaatagcaacaatccaaaatgcaggtttcttgtaattcagcacatttttcaccctttctttgacgccaacctctccaaaggcaagtggacaaaccataactgttcttctattcacgctacaagaaagcagagcttctgaataagaaatagactctttttgattcagtccacgaataactttttcatcgcaggcaagttcaatatctcggcaaagtaaaatatacgcaatccatacaagaggattgaaccaatggattgccaacactaaataccccaacggtttccaccaatggtcacagcgtttcagatgagcattctcatgggcaataatatagggcaactgtgcttcatctgtcccggagggaatgtagatgctcggtttgaagaaaccaagaataaaaggtgtttgtatatcgtcacaaatccaaatgttgtcccgcacagaaagggatgcaccgactttcttttgcaagcggaaatagctgacggcagcataaacgagcatggctatgatgcctattgcccatacgattgccagcacaggaatcaaaagctgaagtggatttgcgcttgcaattggctctggagcaaaggtgtccgtaataattggattcactaccttgtcgatagagcttacgcctgtggagatttctggtgtccagtccatcatgatttcaggactgatggtctcggcacttggaatcaagctcaatgcgctttcaaaactgaatgggcaaatcaatcgaaaaactacgataccccacagtaggacattgatccacttaggtgcctttttcaaaaccacacgcaaaagtacgaccgcaaggatcagccaagatgcggcgatactcatatttacaattttcaaaaagaatgaactcatagattactcctttccggcggctgcatcaatcatgcgtcgaatctccgcagcttcctgttgagaaatacccttcctttgtgtaaaagccgcaatgaaagcaggaagggaaccttcaaaggtttcgtcaacgaactgctcgctctgaacggcatagaaatcatttttagacagaacagaggaaacgatgccaccattattctggaagataccacgctcacaaagcttgcgtaatatcgtataggtggtggagcgattccagttcagttctttttcacagagctttaccaattctctggagtgcaaaggctcattcgcccaaataatatcggcaaagtgggattccactacgcccatcttcatctcagccataaagatttctcctttcagtttatcgctaataaactaattatagtttactcccgataaactgaaatgtcaataggaaacagccattactctcacaggtttcataaagttttgggaagagaatccgctgtcgccacgaagataagttttaatgctcctttccaggtattcttgaaaaatagattccataaatttatcaaaaaaatccgctatactttgttttaaagtatagcggattttagttattttacgatctgaaagcttctagtaataggagctgcctgataattgccaccaattgtaactactgtgactacatatctgcccggctctgtaggagcctttgtgcttgaatatggcttccacttgcttgtaaagccactgtatagataatgcacattgctctggctgattgagacatcaccatcatatgatagcgttgctccaaaatcaaaggatgctacatctgaggctttaagcttcccatttgtaaagctctgattccaactaagcttagttccttttgaatgcatcttgacaagtaaagcaccaactccaacacctgtctcataattcttgttatcggtaaccgctgtcaccgtataaagaccggcacggtttggagtaccaaatgacactctcactgtgtctgcaacagaaggaagcttatttattatctcaagaatctgtccaactgtacccgtatctatatgaagcttcttcaacgtgtcaagcagctcctgtgtgctgaaaagttttctaagctctccgactgtcataccgtcctgcatcatctgtgtaaaggactttccatatagctttgaaacaaccggatctataagcttaagtactgtgctgtttgtatacttctcaggcatctgaagataaatgcctgcatttacattgcttgtaagaccggcatagattgtatatacatcaaacctgtctgaaggatttgttgtaacaaaatcctgtggtagtgcatctccggcataaatgtttgttgactttactttaacatttacctttgccttattaacggtcacactagtctctgctgatgctgatggacgatactcggcattgcctttatatgttatacggatttgctgctctcctgcacccatctgcagataagtaagtaaattaacctttccgccttctatcggagcccactgcctggtgactccctcaactccggctacatcatcaacaccatagtattccattgtaaaatcatcaacacttaacgtatcctttgcaggcaatgtactgttgtcccaatcaattacctgatcaaatattgactgtttcataacggcagtgtccatattgtatgaaaaagatactccctccctgcatacaacggccgctgctatacggttatcggctgtagtcacatttacctgtgtctgtgtacctttatagttcttatttccatcccactttatgcggatagtccactctcccggaccaaattttttaaatgctgcagtccagtttgtagaattaagtggctgccagtttggtattatatctgttccggcattgtactccattgccacatcatcatatgtaagccctgccggatttgtctttgctatcacagcatcataaattgctcttgctgtagcatcaaaatcatatgactgatccgcgttaaaagccatgctcacttcatacggagcatcctttaaaacaaatgatgattcatacttgtaagctctgtggagtgtaacaacctcatcgcttcccttaagtctgaatttgaaatctccttcaccgttttctaaaaatgccggatgattatattctgttgttacagtattccaaagtatttttttcgttgttgtgctcgtaaagccctctaagcttccgaatgctgtatttttctgtaatttagtcttatccttgccctcgcactcgtactcccaatcaaggttttttacatcaacttcgtctgcgtttacaacaagcgcttttgctattgccgctttagcagtctcaatatctgcaccctgcggaataactgctgttccattctgaagctgtactgtcaccttctgtgactcatctgtcaataatgcactgccgctgtcaacagactcataagccacatctgctgcaaatatgacctgcgttgcaagtggttctatcgcttttatttacttatattactgcacactcagatagcttgtcacacaataaagtgtctgtccattatattccacgcgtgaccagccaaactcctcattgattccggttctggtgacggtttccccattttttatcgttgcaacaactgtagcatccggatttgtgacacttggaagtgcacgcagattaacctctatttttgcagtgacagtatcattacactccttgaactttgtcttcagtccgtctccgctgccacttccgtcctgcccgggaactacatagttcatatctgttgtgaggtagtttgaaatggcataatatgtctgtccattatattcgacacgtgaccatccactgtcactgacgcctgttcttgttgctgtatcaccgttattcagcgttaccttaattgtgctgtcattgccctgacttggaatatccctcagattgacgctctccttggcagttacggtctcatttacatccgaaaacttcatatttgcttccgggtcaactgttgcattgtcagccgcatcaccattttttgcagactctgtctcatcaaacccaaagtatgccacattcaaatctaccggcttatcaattcctgacacctttcccttattggtatactgccacatggcatgtgtgccctcatatgatgacttcggtgtttccgggtaagctgtatccggatattgtgacacccatattttgtagctgctctcaagcgctttagtatcccactggctgttttccgacaactcattcatggcagcgtaaaacataggcgtgtatccttttttatatatttcctgcaaaaatgcctcagctactttggtacgggcctctgatgacatgccatactgtctgcttgctgagtctgtgaagccctcgcagtcaaatgccaccggatatgtaatctgatattttgagatgtagtctgcaacccagtctgcctcttcaatggcttctgtttcatttactgctgatgagaaaaaatatactccaacctttatgccatttttctgtgcctcctgcatgttgtatctggcatttgtatcaacacacatctcacctgttttctgggttctgtagcccacacgtatcatcgcaaaatcaattccgcctgcggcaaccttgtcccactttatggtgccctgatatttagatacatcaattccgaaggtcagattactattttccgcaacagtgcttgcagacagtatctgtgtctcatccgcagaagctccctcatcagttgtaacactcattgagccggcattgtcgcccgtatgctgcgggtcttccttgtctgaactatcctctgtggctgtttccgtcatctgtgacgagcctttagcctcgttttttgctgacttaatcacaaaaaatgtggcaactgcagccagcgcagctactatcgcaacaattataaatattgctattatctttcttttatcgttcatagcttttcctcttcatcaatgtatataccatgtataagcaacctgtttttatgcaacaaaatatatcatataatccggtatttttcaaatatttctcccttttcataacttttcaaaatcctttttcagagaaaaaaatccgctatacacctatcgtatagcggattaaaaaaacattattcaattttcatattatttattgcgttaagctattgtgccatttgcaatgtcgttctttgccaataaatatgtaatagccggcataagaatggctgaaataattgctttgacaatattaccaacaccaagctgtgctgtaatggcatatgtaaccatatttactatgaataccagggctgcaagtgcaaaaataagcaccaaaccaatctttttgtgtgcgaaaagcaaaataccgatagaaacagttatgataatctgtagtataacgctaatgaaacacagtacgacatatatcgcacctaatcctaaggtagctcctacgactgaagcgcccagcgcaacgacaagcccgccaattgttgcaagaatattcagcacgaaaataatccataaccatacgtttaaacctgttgaaagcttattgttttccataattatcctcctttagtaatcccaatttttttcaacatattcattataatttaccggaaaaaatatttcaatagtcaaaatgcctcattttgaactcatcccgacctacaaaaaattgtcattgatttaaatgacagatgcatttacaatatagctattatgaaaaaattatttgtaaaatatgtctcacaaaacatactcggcatggtgggtatgtcattatatatacttgccgacaccttctttatatcaaaggcggtcggctcaaacggtatcaccgcgctcaatctggtgctgcctgtatacaatttgatttttgccataggcgcaatgatcggagtcggctccgccatcagatatgtcgtagaaaaaaataagggcgatacatccagcgagagttacttttttcatgccctgctgtggtgtattataataagcattatattcatattgattggtattttcattccggacaggctcgtagggctgctcggcggagattcggcaattataaataccggtaaaaactatacacgtattttcatgctttttacgccgtttttcatgtgcaactatgtgtgcaacgctttcgtaagaaatgatggtgcaccatccattgccatgtgcgccactcttttcagcagcctttttaatattgtttttgattacatactcatgttcccgcttggacttggtatggagggagccgctttagctaccgctatttcaccgattataggcatcctgatatgctgtattcatttctgctcagacaaatgctccgtaaagcttaagccgacggttccatctgtcaagagactcttttactcctgccaggttggtgtttcttcctttgttgctgagatatcatcaggtgtcataactattgtcttcaatatgattatcctgaggcttgcaggaaatatcggtgtggcagcatacggtgtggttgccaatacgtcactggtcgctgtagctttgttcaacggaatagcacagggttcacagcctcttatcagcgactattacggcagaggacttagaaaaaatgtaggctcgatactcaggatggctgtcgtttcatctctcttaattgctgcactgctcattttgttcatatgcacctttgcaccttttgtgacatctgttttcaacagcgagcacgatgccaggcttgcttcgtatgccgagagcggactgcgcctttactttacaggctttatttttgccggaatcaatatagtaggttctgctatcctaagtgccgttgagtccgtaaaatatgcatttgcggcatctatcatgcgtggttttatcgctataagcattttcgcattcgcactttcagccgcctttggcatgacaggtgtgtggcttgcttttccggcagctgaatttgtgactatgtttattattgttaagggattaaggcagcttaagctgtagatgcaggctataggtgtagatgaactattttcgtgcatacttattttccatgtgatatacttatgaataagaaaacctatcacaattatgatatatgatgaaagaggagggcttgtatatggcaaaaatagagagagttatcaatagggattttgaccagttactttccacgattgaagacggaataataaatggcagtgtgtcagcatctctggaggattccagtgactttcgaagccaagatgcgcgttgcagcgtcagggtatttgaacgctacagctataccggtggtaacagggtaagtctcaatgttacactttttcaaaatggcgaggagcctgttcacctttccgcaattacggcaggtggaagccaggctgtttttttcaagcttaatacttttggggaagaggcatttcttgataaattgattgaattgcttgattaaaatagacaaatttttttcaaaagtattctttatgttggaaatcaaacatacaagttgtttttataacgctattattctgtcagaaacataaaaaaactactgatggaggaaaaaaatatgttttgttttcaatgtgaacaaacggccggatgcaccggctgtaccggaaatacaggtgtctgcggaaaaaaggcagatactgcacagttacaggatgaattgacaggcgcactgattggtctggcgagagctgtcgatgacacatcagctgtttcaaaaaagacctggcagaccattatcgagggcttatttaccacaattacaaatgtaagctttgataatgcagcaattgaagatatgatacaaaaggtcagagcagaaaaagcctctctggttggcgactgtaataaatgtcagtctccttgtggacgaactgacgaatatgatatgcaacagctatggaatgctgatgaagatatccgttccctgaagtcacttattctctttggtattcgcggaatggctgcatatgcctatcatgcatatgtcctgaattttgaagatcccgaggtaaatcagtttttctgtgaagccttgttcaagattggttacgcagaaagtatggatgaactgcttccaacagtgctcaaggtaggtgaaatcaatctaaagtgcatggcacttctagacaaggcaaatacacaaacctatggaacaccggagccaacagatgttacgcttacagtggaaaagggaccttttatcgtagtaaccggacacgatttaaaggacctgcagcttttgcttgaacagacaaatggaaagggaatcaatatctacactcatggtgaaatgctccctgcccatgcatatccactcttaaagaaattccctcacttgaagggaaatttcggaacagcatggcagaatcagcaaaaagaatttgatcatattcctgctcctattctctacaccacaaattgtctgatgcctccaaaaagcagctacatcgacagagtgttcacaacagaagtggttgccttcccgggtactgttcatatcgatgaacagaaggatttcactcctgttattgaaaaagcactcgagctcgttggttacaaggaggatcagaccttcacaggcataaatggcggcacacaggtaacaaccggttttagtcattcagcaatcctgtcccatgcggatacggtaatagaggccgtaaaatcaggagctatccgtcatttctttctggttgccggctgtgatggtgccaaaccgggcagaaattactatacagaatttgtaaaacagacgccttctgacagtatcgtcctgactctggcatgtggaaaattccgtttcaacgatctaaatctaggagaaattggtggtcttccgcgactgatggatatgggacagtgtaatgacgcttatggcgcgatacaggttgcaatagcacttgcggatgcatttggatgttcagtaaacgagcttccgctttcatttgtactctcctggtatgaacagaaagcagtctgcatcctcttaacactgttacatcttggtataaaaaatatccgtctcggtccttctctaccggcgttcctttctcctaacattctgaactttctggtagaaaactatgggattgcacctattaccacaccggaggaagacatcaaagtgctgttgaaacaataatatgtattttttccgatgttctaatacactaatagggaactataaaaaacacaggatatagcgcctttgctgtatcctgtgttttaaattaactttaaattaatttgcaatcattagggtaatctaagctaattctccccatacatctccggccgcctgtccctgaacagtccccagctctttctctcactctccagctcatccagatcaaaactgtggagtatgaagccctccgatactctgtccatctgctcaacaacctctccggtcgcatctgtaataaacgaagaaccataaaatgtcagtgcagagctctggtttccgttttccgcacacggtacaacctcctctgtgcctatcctgtttgccgccacaaccggcatcagattgcaggctgcatgtccggtcatacaccgtctccaatgcggcatactgtcacattccagtatcggctcgctgcctatggctgtagggtaaaaaagtatctccgcgccctttaaagccatgcctcttgccgtttccgggaaccactgatcccagcatatgccgactccaatggttgcatatcttgtcttaaaagctttaaagcctgtatttcccggtgtaaagtaaaacttctcctgataataatgatcgtccgggatatgtgtctttcggtatattccaagcacctctccgtcggcatctatcaccgccactgagttgaaaagctgtctgccctctcccgcctcataaaagctcacgggaatcactacgccaagctcctttgcaagtgccttcatgctctgcaccgcatcattttcagaaagcggctttgcatagtcataataatcgtaccgcctctcctgacagaaatactgtctctcaaaaagctccgaaggaagtattatctgcgctccggcccctgctgcagctcttataagctttgctgctttttcaatattttcttttacatcacggctgcagctcatctggattgcagcaattgtaacctctctcatactattcacctttctcatcctgaattaaattactgcggtatctgctgtgtgatacagtgtatatttcccccgccgacaattatgtcgcgcgcatatatcggatacacttttcttccctcaaaaaggcttccgattgccttaagcgcaggctcatccatcacatcaccaaactgaggaatgagcacaccgccgtttgtgatgtaaaaattcacatagcttgccgctaagcgttctcctgcctctcgctcatcctcaccctcctcaaaggtgaagccggaaagctcatattctgtgatacacaccggcttctttggaatgtaaaccttgtgaacctcaatttttctacccctcgcatcagtttcattttccaatatttcaaggtccgctgaggacatctgatactgtgggtcatccatgtcatcagtccacgcaagcaccacatgccccgggcttgtaaatgcacatacgttgtccacatgctcgttggtttcatcattgtatattccataaggaatccagataattttctcggcaccgagataatcctttaatttctgttctatttcagacttcgataattccggatttctgcccttgcttagcagacagctttccgtcactatcacagttttctctccgtctgtgtggatggctccaccctctaagacaaacggatgcgcatcatacaggtcgtatccggctttgttgcaaaataaagccgctactctgtcatcctttgtccagtctgcgtacagtccgtccaccttgccgccccaggcattaaaacaccagtcgattcctctgacagcgccatcctcatttttcacaaaggtcggccccacatctctggcccaggcatcatctgactccatttgtatatatttcaccgggaaattttcctgataatttttctgctttctgacagcttccacaacagaccttgcattgtctatcacatctgcctcagcgagcacatatgcctgttcagactctgctattgcacatatcacctcagcaaaagcctctcttgcccgcctggcaccgtaaatccatgagcccgggcgctttggccagatgatgatagtacccttgtggggagcatactctgccggcatataaaagccgtctgctctaggacagcctgcatttaaaatcttcatattcgaatctcctgataaccttacaatcgttattttcatccattactgcaatgtccggaagcggcatgccgttaaaggtattatttttgaccatcgagtagattgccatatcgcaaaagcacagcctgtcgccagtttttatctctctgtcaaatgaataatcccctatcacatcacctgccagacaggtacatgaggacaatctgtaggtatacttcttctcacccggctcgccactgtccataagcggcggacggtacggcatctcaagcacatccggcatatggcaggctgcggaggtatccagaatgagtatctttatgccattgttttcaactatatcaagcaccgttgtctccagatatcctgcatcaagcgcaaccgcctctcccggctccagatagatttccaggtcgtatttgtcacgcatatgcataatgcatttttcaagcctctcaatgtcataatctgcccttgtgatgtggtgtccgcctcccatattgagccacttaagtccatacagtaaatctccgaatttctcctctaccgctgcaagagtcgtttcgagcgcatccgaatcctgttcacagagcgtgtgaaaatgaaagccctctatacgtgataaatcaagcccgtttttaatagccttatcgagtgcctctctcgttatcccaagccttgagcccggcgcacatgggtcatatatctcatgcccctcctgtgtggagcactcagggtttattctgagcccgacacttatttttttatcagccttttctattttatccctgtgaagcagatactgcgatacggaattaaatacaatatggtcacatatttctaccagctcatccatctcctgcggcaaaaaagcgggacagaatacatggttttcctttcccatttcttcatgtgcaaggcgggtctcaaaaagcccgcttgcagttgtcccgcttagatatctgccgataagaggatattcataaaatgcgctgaatgccttctgtgccagaagaatccttgcacctgtccttcgcatgacaccgtttaatatcaaaagattttcagttaattttccctcgtctatcacataacagggagttcttaattcatttatcttcataccggcctccggactaatccatatgtactgactcatcctcagtcttgtaacaatccacaggaaccggattctccactacctgccaaggcagtccgaacttattaagagcctccatgtatggatccggatccatctcctcgagattgaacactcccggcttcttccagattccctttaccaccatcatggctccaatcattgccggcacacctgtggtataagaaatcgcctgcgactcaacctccttgtagcactcctgatggtcacatacattatagatgtagattgacttttcctttccgtccttgacacctgtaaaaatacatccgatatttgtctttccgactgtgcgaggtcccaatgatgcagggtcaggaagcagctccttaagcacctgtattggcactatttcctttccgtccaccatgatcgggtctgtccttagcatgcctacatcctcaagacacttcatatgtgtgagatagctctgtccaaaggtcatgaagaatctgattctctttattcccggaatatttttggcgagcgactcaatctcctcgtggtgaagcagatacatatccttttctccgacctggtcaaaattgtactgcgctctccactccataggctttgtctctacccagtggccgtctgtccagtatgagccgttcgcagaaacctcacgcagatttatctcagggttaaagtttgtcgcaaatgggtatccgtgatcaccgccattgcagtcgagaatgtctatagtatgtatttcatcaaaataatgcttaagcgcatatgcagaataaacagaggtcacacccgggtcaaatccgcttccaagaatagccgtaagccctgcctccttaaatttctcctgatatgcccactgccatgaataatcaaaatatgccgtaaatccaagctccttgcagcgcttttcgtagattgctctccactttggatcctcagtatcctcacactcatagttggcagtatcgatgtagtcaacaccacacgcaagacatgcatccatgattgtaagatcctgatacggaagcgcaacatttaaaaccgcatccggcttgtatgcattaatcagttcttttaattcctccacattgtcggcatcaacctttgcagtctcaatttttgtgcttgtctttccctcaagctttgcctttaaatcgtcacattttgacttggttctgcttgcaatcataatctcggtaaatacctcgctgttctggcagcattttctgattgccacctgcgcaactccaccacatccgataataagtaatctgctcatttttgtcctcctgattcgctttggttatgatatagtttttctaatttgttttactttgtttcctcttcctcgagtaaatcctccacatatttcggaagcatgaaggctcccctgtgtaaatgtgttgtataataccaggttttaagccccagtgcatcccatctttttgcatcaagatcataaagcggatgatatttcttcgatgcaaacccaaacagccagtagcctgacggacaggttggaatatgtgcctgatataccctgcttataggaaatgatttatacacctttctgtgcattttccggcactcaagctcatcctcatcataaaaagggctgccgtgctgataaaccatgattccatcatcctttagtgccttataacagcttccgtaaaactcttttgtgaaaagtccctccgtatgtccgagcgggtctgtggaatcgttgattatcagatcatattcatcatgctttctgcgtaaaaatcgcagaccatcatcataaaacatggaaattctttcatcctcaagtccacatgctacctcggggaaaaaccgcctgcatacatcgacaaacatcttgtctgtctcaaccacatcaatatgctcgacagacggatatttgataagctccttcgccacgccgccgtcgccaccacctattataagtatctttttggcattcgggtgaaccgccatcggcacatgtgtgaccatctcatcatatataaactcatctgtgtccgaaaaaacaatctcgccatccagcgcgaccattttgccaaactcatatgatttaaacacatctattttttgataatcactctgccctgaaaaaagctgctcctgtatccttacatccagcttgacattggcagtatgatattgtgaaaaccacatttgcatagcttttcctcctgtttactgctccaataccttaagatattctaccgcaggatcctctgttccctgcattgaacagcccttttcctttgcgtagacaatgtattgcgcaatctcttttgtaataagctctcccggtgcaagaatcgggattcccggtggataacacatgacaaactcaccacttacagcgcctaccgcgtccataatgcgcactgatttcttctgcgaataaaacgcctcctgcggcgataccgccacctttggatttatgtactctcccgacaaaagtccggtcttgtccttgctgtaaaggcgcttgatatcctccagcgcacctacaagcctctctatatcctgtattctgtcaccaattgatatatacgcaagtatattacagatatctccaaactctatctggatatcatactcatcacgcagcagatcatatacctctattccggcaagccctatatcgagcgtatagatggacagctttgtcacatcataatcatatatgctcgtgccatttacaaggtcacgcccatacgcataatagccgcctatggaattaatctcctgccttgcgtactccgacatctgtgccaccttggcaaaggattcctcgcctctgagtgccagatttcttcttgatatatcaaggcttgacaatagcaaatacgatgcgctcgtggtctgggtgaggttgataatctgcctcacataatcagcatttacatcccttccggtgagcagaatcgagctctgtgtcaggcttcctcccgatttgtgcatcgataccgcagacatgtctgccccggctgccattcctgatatcggaagcccctttccaaagtaaagatgtgtaccatgtgcctcatccgtgagcaccttgattcctttcgaatgagccagcgcaactatcgacttaaggtcagaacagattccgtaatacgtcggattgtttacaagcacagcctttgcatccggattttcctcgatagccctcgccacctggtcaatctccattccaagcgaaataccaagcttcgcattcgtctgcggattgacataaaccggtatcgctccgcagagcacgagtgcattaagagcgcttttatgaacatttctcggaagtataatcttgtctcctgccttgcaggtggacaaaatcatggcctgcaccgcagaagtggtgcctcctaccataagaaaggcatttgccgcttcaaaggcatccgccgcaagctcctctgcctctctgattaccgaaaccggatggcacaaattgtcaagcggcttcattgaattgacatcaagccctacacacttttctccgagcagatgcaccagctcaggatttcccctgcctctcttgtgtcccggcacgtcaaacggcaccactctcttcttcttaaactcctcaagagcctcataaatcggcgctctttcctgtcttttgatatccatttacttctcctgtatttaaaaaggatgatgcgtgcaagcatcatcctttagattcgtcttaacaacagtaaaatcgtaacatatactatggagttatgcaagaaattacgttttatttttgctaatgatagttacaccattgcaggctctttcttcttaataattgcctcaacttcatcaacacctgtttcagctacatctgcgatctgatccaatgtataaccttttttatacatattcagaataaacttttcgcttgtcttttcagtagctctttcagtagctctttcttcaattcctgtactcagattacacataattctcacatcctctctaaattcttgattaattggaatattagatacccgcattttccggctccattcctttaaattcatagactgaaaggctctctgtcttaatatcattataagcgagggactttacggaatcaactgatttttcattacttactattaaagaggaagccggtacatgtggagtgcaccggctaaactaaaaatatgaaaaagattaatatgagtatttcttttgtttacagtgtcagtatacggggcaattgtgaaaatgctgtgtttactttcttacccttttataaacaaaatgttaatgcaacacaacaaaagagccctttcgagctcttttgctttgtacaacattaaagtgtagatgattactgtaagagtgaaagtacaccctgattagactgattagcctgtgcaagcatagactgtccagcctgagcaagaatattgttcttgctgtagttaaccatctcagaagccatatctgtatcacggatacgagactcagctgttgtagtattctcaactacgttgtcgaggttgttaatggtgtgctcaagacggttctgaactgcaccgagtgatgaacgctgtgatgaaaccttgctgattgcatctgagatagcgtcgatagcgtatgtagcagcgtttcctgaatcatctttcacattgatacccttgataccaaggcttgcagaatccatagagtcaatgttgacctgaatcttgtttgtcatgtcagcgtcagaacctacatggagactaaagcttaaagtgttggcaacctgagcttgtccagtctggattttgaatgttcctgttccatttgtaaggtcaacctctgtaccaacatcaccgacacctacttttgcttgatgctctgtgtcgccaatctggtttgccttgagtaattcctttgatgcaagctcatatgccttatttttagagataactgttgcatctgtatcagagataccatcttgttctgcaacacctgtcaaattgtttttagtatcatttaaagcagtaattgtcttaccgccaaactctgcttttgcaccagctttgacagcatccttaattgcatcaacattggcataaactggcgatgtcacagtatctttaccatttggagcgttaggtatagtattagcataccaacctgccttgactgttcctttatcctgagcatcatctttggctatttccgttgtatatttatattctgttccatttactttaaccgttgcatttgctgcatcagtaatattattatctgtaaaccaagcgtcaacctttgcttcatctgatccaatagtataagtttttccaccgatagaaaccttatcaccagcattaagagcatccattacgaatgttgctgttccatcgccattgtctgtcagtgttcccttaagacctgcgtcatgagctttcatgttgattgtctttgttccggcatcgccctttaagaggtatgtctcattgaacttggttgtttcagatacacggtcgatttcagttgttaactggtcaatctcatcctgaattgcctgacggtctgaatccttagagtttgtgccgtttgctgcctgtgttgcaagctcgttcattctctgaagcattgagtgaacttctgttaatgcaccctcagctgtctgtacagaagatacgccatcctctgcatttgttgaagctctgtcaagacccttgatctgctttctcatcttctcagaaattgtaagtcctgctgcatcatctgctgcacggttgatcttataacctgatgaaagcttctctgtgctctttgactgtgcgcttgttgttacgttgagcattctgttggcatttgctgcctgcatgttgtgttgtactaccataatataatcctccttggcccatattcatgggttattatgtttgacctctggaaatccttttcccgagggttttgcagctgctttgtgtttattttttatttaagcagctactgtttttataacaagcggcttcccgggtgtggcagatgccacagccgcctattaacatggttagttgctttgcgtctttttctgacgcgctttttctttccagatgatgcgctgtatttctttttgtgcctcattggaaatctcagggtcgggataatatgtatcttttcgcttcgctgggtcaggttcgttgttggatcttgcgatattcagttcttttggggcatctatcaataatcgacagtgctttccggttccgcccgcgaacacgattcggatatcgtctccgatgtttacatattgcccttcctttaatgataatttgagcattttctacctccatgcactagggaatagctttgtccatgcttttccgaataatgtaacattttgtagtaaaatgttgcatttttcgtggattgataatgggtcaaaaaggaagtggattaaaaaacatcaaatgtttacgccaatttagtcatatttcatcaagaattactttatctttggcacagatatgattaaatccggtaagactaacaaaaaaaacatagaaaaatgaaaagaaaattattgaaaaaattattttttaggggttaagttctgaaaatggcgtccgatatagtaggtgtaaagcaaaaaatgcaacattttactacaaaatgttgcattttttctattttgaacttaccattattgtgttgtggattttggatattctgagggtgaaagtctgtcatattgtacgtgccggataacattttctactataaaggagtattcaatgggaactacacagccaatccgaaacaaggacgaactcacggctttcaggatgtactataaggacatccgtccaaacagccgcaattactgtttaattgtgatgggattaaacacagcactaagaattagtgacctgcttaaattaaagtgggacaacgtttacaatttcgagcaccatgtatttcgcactcattttcttatcaacgagcaaaagaccggcaagaataactatgtcactctaaactacaatgccaccgatgctctgaaagattatttcaatgaacgtaatccaaatgaccatgaatttatttttaccaagaatacctgcagataccagcctataagcaggacgcaggcatatcgtattgtaaagactgccgctggcaaaaccgtgcaggatgagcacatcagctgtcattcgcttagaaagacgtttggctatcatgcctggaaaaatggcacacctcccgctctgctcatggatgtttataatcactcatcatatgagattacccaacattatttagggattgagcaggatgagagggatgagatttatctgaagcttgaattatagtaccttctattccgccggccaggattttctgagagccacataggaaatcaggaaattggcaagccagccggccggtacagcaagccagacaaatgcaataccgaaacgcggcgcgcagattagggcaaccgagaggcgaattgccaggtttaccatatttgcaacgagaaacggacgcatgatgccaagtccacgaagcacaccatcggtggccatcttgatacccatgaaaatgaaaaagtagccgagccatctcatataatccccggatacctgatatgccagtgccgttccgtctttacccaggaataacgaggaaatctgagtatgcagtgtttcaattactataaaagcaagcactgcaaaacacaggtctaacaccagcgcagcgtgatagccttttttgatacgttctgtcttctttgctccgagattctgggaaacaaacggagaaactgcatttccaatggatacaaatatcagtgaaaatacattctcgaccctcatcgttgccgaatatcctgcaagcgcctgtgtaccgaacggattcacaactgcctgtactatcatcatgccaattgacaccgtagactgctggagaaccgaaggcacagcaatccgaagcatggaatgaagctcatgcctgtcaaaccattcaaagcgacttttataccggcgcatcctgctaaagaaaatcaaaagtgaaaacacagcagatattccctgtgctatgagagttgcaagtgctgcaccgaacacacccagctcaaggcctgccaccatccaaagatccataaatatatttaacacagaggaaaatatcaaaagccccaacggaatccttgactcgccaatcgatgtaaacatcgttgaaagtatgttgtacataaacaaaaagggaaatcccacaaaataaaccctaagatacagcactgcctcatccagtatatctgcaggtgtctgtagcaagctcatcattgaatgtgaaaagaaaaagccaaagaaacccagaagtacgcttaaaaccagaaaactaatcagtgatgttgatactattgttttcattttgccgtaatccctggcgccgaaatagcgactcacaagtacaccggctcctacaccggctcccagtgctatacaaatgaacacattcgtaagcgcagcacaggctccaactgccgcaagtgcagaggagcctacaaactgaccaacaatgattgaatcagccatattatatacttgttgaaaaaagctgcccaaaatcataggcattgcaaaaactgtcagtgcctttaacggggcatctgtaattagatattcatcttttgacattatttttccctcattccgctataattaagctatagtatatccgattgaaaggcaaattacaatatagcattctttatcgacatttttccatttcttatgctttccctctaatgcaaacatcatactgctcctttgtattttaatttaaaaagccgcccaggccataggcctgtgcgacttctcataacatgatttaaattaagtttatccttcaatagcaatatgctttgtggtctcaactttcttttgctccttcttcggaactgaaagtttaagaataccgtcctcatactttgccttgatatcttcctgtttcagctcatcgcctacatagaaagacctgctcatagcaccggaatagcgctccttgcggatgtacttgccatccttttcatccttctcttccttgtcaagtcctttggctgcgctgatagttaagtaaccattctccagcttagcctcaatctcatccttcttaaatcccggaagatctatatctacttcgtagctattgtctgtttccttgacatcagtcttcataacgttctttgcgtgtttaccataaagcaccttgtcaacatcaggaaatgaaaaatccatccaatcatcgttaaataagttttctccaaaaatactaggcatcaacataagtcatctctccttcttaatctataaaatctgtgtcaacctgtttctttggaaccgggatgtttcaagaactcaaagcctttgctttttgttcctttcctttgttcttgactatgttatacacctattattagcactcgtcaatagcgagtgctaataatttataaaatgtttatattttccgagcagcttcaaagtacttaccatatgaaactccactattttgcaataaataacactccgagtgtgccaggcccacaatgtgatgaaatcacaccacctgctcttgtctctataatttccttaaaaatgccaagagaggctatgtaatctctcacctcttcaactgtcttagcatcacattccgaatgtgtaataaatacacgatccggtattgcgtttttcaggttctcttccagatcttttgcataattctttatgactttaccgatcttacctctatatttcctgcttgcatccattttaccatcctttacaacgatcatgggatgaagcgccaatgctcctcctataagcgcagaaacagcattgcatctgccacctctgtaaaggtacacaagtgtatctacaacaaagcttgctcttaccttcgggatcaattcatcaattccggcttttatctcctcacgggatttaccatccgctgccataactgccgcctcaacaacaagcaggcctattcctgtggacagatttcttgaatctatcaccgtaactttatctactgcatcaagttcttctgccgccattctgatcacgttgattgatgtcgacatctcacttgatatggaaaagcatatgatctccctgccttcatcaatatatggtcgcattacattcattgctgtttctatagatggagctgaagtctttggtgtagtcttatttttatcagcccactcatacaatgcgtgaatgtctatctgcggtccgtcctccagttcttcatctccttttacaatatgaagcggaataatatctatatcgtatctttctaaaacttcctgtgacagatcacatgtactgtcagatataatttttatcatctttaatacctcgttttctgttgaatccttcatctaagagaactgcgccaatctgtattatttcaccggcgtatttatatattttcttaatgacagctatggcttccacatccatgctcaccacatgtatgtccttccccatggttgtgctcatggtgagaacacttcacatccggattataatcaagcgcatcattgataaaagcttctactgctttatccgcatctcctgaaactccgccaaaaagcttaatgcccgctgcatattttttataaatttcctgtttgtaacatcctccaaagctgcagttactgctcctgactataacctttcttgtccaaaagacggatggtttcatactcatccacggtcaaaacaataggtgtgcttttctcttttttccattctatcacaatctcaccattaatcatcaattttttgatatttttctttccactactgtaaagcagcctctgaacatttcgttatacagatggatacaaataagagcaagatccaccatctacacccacaaatgctaagttatctttttcttcctaaatatctgcatacttttgatttgtattgcaggtactcatttccgaatgcttctatcaaaaaatcttcctctacattgactatctgcaaatgaaaaaataacactgcaaaaccggtggcatagcaaaggaaccaattaaagaacgaaaacaatattcctatatacattaaatcaaaacccaaaaatgcaggatttctgctaatagaatagatgcccgttgttaccaaactggtcttttcttctttttgcacacctgctctccaattctccttcatttgtgtaacagaaacaataaaagcaagtacacctaacattgttattacaactcctgtaaattgcaatacaatatgtgctgttcccgaataaaacacaatactgataatctgtattacaggaagtaaatatgtgattattttaagagccacttctataaatttgacaaatccctcttttccttttcctaattgttctgtctttatgccttgatttttctgactaatcagctttgcaaaatagcagatgtagaacactgccatcagtgaaattgtaacaatttttattatcatcgtgtacctccacaaatccaatctatcaaactcattttatcaaaaacggtaagagataaaacggttctaacatatcacaaaatatacattccttcaatttatatgttttatattatgtgcgtttcttcaatattaatttcagcggttttgtgcttatattcaaaaattctgtggttgtggtaaataatttgaatgaattcaatattatgcttttttctccttaaatggcttcagaaagatcacccatccaaagatcagcagattcattaccagtgcaacaggaatatctccccagtggatttgctgattctgaagtacatccgcagagtacgttcctgaaaaaactaccaccatattattattcagaaaatgaataattatcgggacccagatattctgggttttcatataagtatatgccataaaaatccccagtgaaatacaggtaacaaactggcttgccagagccgccagccccatatccggcgtagtgtaatagaagaagtctattggcagatgccatacagcccacacacagcccaaaaggattacgccgccttttagtccaaattttttctgaagaagaggctgaagaaaatatctccatccgtattcttctccaaagaatgccactactgacaggaaaaagtttaccaaaacggtaaaaaatatgatccaggtagtaggatttgccattattttgccaaattcagaaagctggccgctcagagcacaggcaatcacaaatctgagaagatataatccaataaacaacaggatcatacgaatagatatattccaatgttcgctgttcagtccataggatctgcgcttttctttaccggattgcagaagaagaatccagaaaataacgctgccacctattataacgtactccatgatcggtgcccactgagaatatggcatgctcatcagatctctattttggggagccagaacagaagccgccgtgcagacaaccagcaccgccgtgagagctacaaagaatatgtaaaaagccgttggaagatttttatctccttttttggtaattaaataagccatcatcacacctgctgctggatacagcatctgcgcatttggaaaagcgctgagatcaagaccttttccatagctataccacatcagaagtcccattacatatgtgattccgtatgctataatcacatagatcaatagctgttttttctctgtttgcataaatttcataatttcctccttgcaacttcaaagttatttacttctcttcatactttttaacgataactaaactataagcagccataattacaattgtttccaccatcacaccaataaccgacaacagaacgtatggtgtattttgaccatataacaaacccaatcatattgttgctccttacaaaccgcattaaaaccataatgagacacattcttgtatttccccaaatcgagatttactaattctacaaattccgatttttcaattctgtcagcaaaaattgttctatacaaattctgcacctgcttcatgtaactttttaaagtacttattcttgtttttctccaacacatacattttgcatgtcaattaccaatagtgctttttcacagttctttacctccataaaatttactttatcctaagtatgagaccactgttcttttgtaagataagtaaagtgctccgttctaacatctcccataagtgcacagggtttattttcttccgtatgatgatatttgaatccacatttttcctgacagcgttttgatttttcatttccgtcataatatccgcaccacatagcactacaacccaaatctaaaaaagcatgcttctgtaaagctcgaaccgcttcgggaatcaagccctgcccccagtatggaacacctatccaatatccaatttctatttcatcatcagctgcttttgtgtgcgactgagctggcggagtcaatccgatacttccaattgcaacattatcttctcttaaacacactgcatatgtttcatctgctgccaaaacacttttgatgatttctctgctattctctacacttgtatgtactggccatcctgctataggcccaacctctggattttttgcatatttatataaactctctgcatcatcctctttccagggacgaagtattaatctctcagtttctaatgtcataacctactcctttaccaactgctttctaatataatttgtgatcgaatcaaatacgactggggacattttaacaatccggctccacattcgaattccttgatatactttttttcatgtaaagcacctcctcgttaaacttgaagttagtaacgcaaaagaaaatatatgacatacacccaactaagtaatccatgaaaaatcgcccagccaacagacttccacgttgtataactaataaccatagctaatacacttccaaaagttattccggattttaccgttttcttgacagtcgttgatttattatcttccatttttgttttctccgtatattcctattttcttaattctgcaagctggaagttatgaactcaagctcgttaccagtgacgaatatctttctgtcttatttataatatcttcctcagtaacaccataataactgtataaatctctggctattttcttaaactttttcattaccgctttatttcctgaataagacattccaaatatattccaagtataatctatttccatttcaagaaaattatcattaatttctattttatacaaatgaaaatccataggaattatactatcaggcatttcagcaatcatttcacttcgagtctttattttaccaaaatgctctataacagatgcttcattaaaataatctggtaatggaatatccttcatttcacccaaaagttctggttcatgttgcaaaatcaaactttcttttaggcattttatttgttcaatatattctctattgcctggagcagtttctgtcaatccgtatttttcttttgcatactgtactgtttcagaaagagaatgcggatttgcaactattgtcttctctacttttattctcttatatctatatatgctatttttgatcctaacctttaatggttgcttttctgaaggtccagctataaaaatgcttgtaggaccatctgcaccacctatgattgaaaccccatttttgcttttttgctccattcgtcttttcctcacaaatcccgattgaacaaaatcgctgcgcgatggcctgccaaggctgtggcgcagttttatttttattaaaaagcagtggaattacttttcataatccgttattgttaagttaccacacgaaacaactgaactaagaaagctccactgcctatgataagaataacattttccagtctcttccgcaatcggaattatgacgctaatgcacctccgaataggtagatgtaattattaacactacttattctggaggttttattatgtataaagatatttttgaatctatccgcaatgaagcggaaaaacgtaacctgcgtgaaagaactattcaactgtattgctctgatgtcagttacttccttcattggattggaaaaaacgtttctgatcttacgcttgaagatgcggaaagttttcttacagccaaacgtctggaaggaaggtctcctgaaactcacaatcactatcggtctgcaataaagttcttatataaaaaggtgctgaagactgtctgggatgatgacactgttccagctatgaaaagagagcgcaatcttcctgctgttctgtcccgcgatgaaataaatgcaatcattgatgccactccgaatctgaaacataaagcgattattgcaactatgtattcttctggattacgtgtatcggaggtcgttcatctccattatgatgacatttcccgtaccaacatgacaattcatgttcgtgaaaccaaaggcagaattgacaggtatacaattctgtctcaaaaaaatttagaccttctcactgagtattggtacaaatgtggtcgccctaaagatatcctttttccaagttcctggaccggtggatatcttgatataaccggtgttaaccagttctttaagaaaagtgctaaactcgccggcattacccgtcatgtttcctctcatgcgtgccgtcatagttttgccagccacttattcgaaagtggcacagatataaaatatatccagtcacttctgggacatgttgatcctcgctctacagatgtttaccttcatgtgagcaacaagacacttcttggtatccgcagcccgttcgacaacccggaaggtggtgaatcatgagtaaggattgtacgattcaggatgtttttcatcgtttttattcatcttttgaatccacacatagtatttctcccgctcagcgaaaggccgcttatcacatcatgaattgcaaaaccggcgcctttggtgtgaatgtaagcgtatgcgaggactgcggctgcatatcagtccactataactcctgccgtgacagatgctgtcctatgtgtcaggagtttccaaaagaaaaatgggtagatgcacggcgggaggatatcttagatgctccttatttccatgtggtttttacagttccggaagaactcaatcccattatctacagcaaccagaaattcttatacgctgctctttatcatgcggcttcagatactctcagtgaacttgctgctgacagtaaatatcttgggactgatatcggctatatttgtatcctccatacatggggaagtaccatgaactttcatcctcatatccatgcgattgttcttggtggagggctggatgtgaaaaatcattggaaagacaatgggaaagattttttccttccgattaaggtaatctcaaaaacatttcgtggaaaatacatggctgaacttaagcagctctgggaaaatgacaggcttgaatttcatggatcggctgcaccttacaaaaatcactatactttcaaggaattgttaaatacctgctatgcaaaggaatggattccttattgcaagaaaccatttgacggtgccgaatctgtcatcagataccttggaaaatacacccaccggattgctatcagcaactaccgtatcaaagacatgacagaatctacagttacattttctgctaaagattacaaaaaccaagggctttggaaagagatcaccatatccggcgaggaatttatccgtcgatttttaatgcatgttcctccaaaacgttttgtacgtatcaggcactatggtcttctttcatccagaaataagaagaaaaagattaccctatgcagaaacatccttggttgcaaaaaatatatttccaagctgaaagatatggatgcacctgccattatccgtcttctttataataaagatatatgcaagtgctcttcctgtggtggtaagattattcctctgcctacagaacaacattttataaaaccaaaaccacatatgctctgttaacgtatcataactgtatatttttttagcttccttagggaggcttatttctggtgtcataatacaggactgaattataaattctatgtgtttctatgtgtgcatgctatcctattataaatagagtgtcagaattaaaagtccatatagagttgacgcgctttgttcaaccagaaaaaatcgaaattgatgcaaacgaaagggcagttaatgaaaagtctcaatactgctttttcgtttgcaccaccttcgattcttttcttaacgatttatcaatttcattaaataataaatttcacgaactaactacattgtcaaaaaattcattacaagattcaccattatatctttttcttctggtcttgactctgcaatcataagcgtaatcgcaaccaatgctccatcactgattatcttattatcatctctatataaagcattattccgagcaaggaattccaaaaataacgatgctgcaattcgcttacatccatctgcatatggatgatccttaatcataaaatataataaattagcagctttttcctctaatgacggatatacatctccaccaaacacactctgataaactgctgccaaaataccctcaactttaccattttctttctccacaccgaatacatccgatttaaatgaatcctccatgtgtgaaaccatttttttacattcctcatatgttattttatatataggcctgtttcccactggttttttaagagattgatgatcatattggtctaaaagcattaatgcatctgtatacgaggtaacagcctttaaaatgtccgattcttcaacctccaatgtgcttgcaagcatctttgtttgaatatcaacagttctttcaagtgcttgcaagcgtttttcattaatagcataaccttgaatcacatatttctttaaaacagaattagcccatctacgaaatgcgatgcctcgttttgaattaacacgatatcccacagataatatcatatcaagattatatatcttaggttttcgtcctccggaacttttatcggaaaaaccgatagaagtctcatccaactcgcctgacgatataatattattgatatgttcacttaacgttgcctgttttacttcaaacaattctcccatttgtttctgtgttagccaaactgtttctaattctggacttagctcaacttcaatatttatatcgccatctgtaaataaaacaatttcatttttcaaaaaaatcaccctccttatgaatcgcgcacgggataatcttgccctgcgcatccgttctgtaaataagaatttgtaaatatcattttacatttttatatgaaatcacaatatgacttggtgcaaataatactgatgcaataatcaatagcactgacctactcataatcccactaaataagaacaacattgaaggaataatagaaagtgttaatgctctgaaaacgctgtttttcttaaaacatataatccaaatagcacaataaagcattaccaatatggtatctacaatcagatatagtgcaaatgcttcgtcagaccaccacccgaaccaagttcccggaatattgattatcatgaatccgaaacaacacaatctccctacttgttctgtgacctcaacatatttattgttccacttattatcaaatccatctttgcacttaatcgcaaatacaacattgggtatcataatgactgcaataaaaatcagtccaaaaacattaaaccattccatattatctaccatcacaaacttgaattgagatttcatgtattccaaggaatttaataattgttatattttattatcaaatatctctcaagcccttgaaaacactaagtttatcgcaggtgagctttcccttattgtttcccttgtattatattgtcccaccagtgtttacgaactctgataagggcaaatacaagggcaagaaaatcctataaaacagtataacacaaaattaaaacgacatggtgaactgattgaaatgcttctatttttttaacaaatgattgattgaacgataaggagatttgatacgatgagaacgatatttgcagaatacaatccacacagaaacagcattgatgtatataccagtgctggctatatgctccgcattgactgctgggaagcagaaaagaatttaaaaacaacacctggatcagattgtgcgttaaatgcacttgctattgatgaaccacttgaatatgcaagattgtatcttgatggaacgatgcaaatgtgggtagatgcggaagattccttagaaatttaattcaaagataaataagggacaaataacccttttagatttatttgtccctattattctatattttttcacttctgacaatgcagatgaaacttttaaatttggtattttccagtatcattgttcagtttttattgcaccagacagggcattgtatccattttgtttgtatgtattttcccctgttactcaatcataatttccttgatagaaatcttcttaattttttcagaatatatatacatcataatttcataaatcgtgataaaacaagcaagagaaataagcatagtaggaaagtcaaatttatacgtaggtacaccctcgacatccttaaatacaatatccaccataagccgaagcaatccatactgatatactgttccgattataaaaccaatataggacagcggtctgtatcctcctaaaattgccctgcaacattctttctgtgaatagccgaatactctcatcatagcaatagtttttgtatttccgtttattactgtagttatagcaagaaacagagttgtaaacgctaatacaagtccgatgaccaacatcatcacacccatcatttcacttgataaatctttcatactaaacgacatttgtgtcatagctgaaaagcaaaacgaagcaaaaataatgaagaatacaagtgcctttttagatttcaaggtattccttttcaaatactctacaaacgacaattcactgcttttttcgattctatgatttggtgttttagaagcagtttgcatattatctttcaaaagcagcaacacaggttttttgaatttgtaccaggcataataaactgaaagtgccgaaaaacacacagtcggcaataccacaaaataaaataaaatgcttggatgaaaattgatagttatctcaggaagcattttatcttcattttgtagagcgtaaaaccacggcattataagaaatgctcctgcatatccggttacagttccaataaatatactaattccgaatacccaaaagctttttgcaattttgatatttgaatatcccaacgcctttaatatcccaagttccttcttatgcgtgtcaatataatgcttaatataaaacaacaacataacaatcgcagttaaaagcaagcatccgccacttacaaggcaaacgacttttgcggtagaaacctgagcattataaaaaaacattgataattcagatgtaatttcactctcaattaatcgaatatcaaaataaaagttcagaaacattgtacaaacaagaacagcacaacaggctataatggaaataccgatgagttttgaaacattttttattccaacgagcataccatcaccaccctatctcataagcagtcttttgtgcttcatttgtgtaaatttcagatatttttccgctattcatttttataactgtgtttgccatttccgcaatattcaaattgtgcgttaccattacaatcgtaaaaccatattccttttgaagtttacatatataatcaagaacctgtcgtcctgtttgttcgtctaatgctcctgtcggttcgtcaagaaataatactctcggtctttttgccaaagctcttgcaatagatactctttgctgttcgccacccgaaagttcgctgggatatttatgtagtttttctccgagtccaaccgctctaatgacgtttttataatctttattatttgctaaatcagcacccatttttacatttttatcaacgctcatattgggtagcaaataatactgctgaaaaataaatccgacattttccttacgaaatgaagttaattcattatcagaaagtgctgtaatatcctttccgtcataaaacactttaccgctgtcagggcgttcaagacctgaaattacattcaaaaaggttgacttgccagaaccagatgcgccgagaataaccacaaaatcattatcctcaatatcaagactgatgtcctttaatacttggaatcggctttctccgttttggtaggattttattatatttctcgctttaatcattattttctccttccttcagctttttcaaaatactcatacatacctcagtaatcattgtactgatttcttcgtctgtaaatcggcacatttttgtggcacaaagcgttgcaattccgtgtgtatatatccaaagatgatgatacagttttttcccagctgccttgcaaattttgtaatcatcttgaattgacaatagaatttgctcataactttcatctatcagcggaagtacaccagataagtcaggaatttgtttttgctccgtcataaagaggagttgaaaaagcttaggctcattaacagcgaagagaatatattgtgtacccacccctttaaacgggggctctgttgttagtcctttattgacatattctttatacagagctttagcagatttaatcatatcctgctgaacctcctccatatttttaaatacagtaaaaatgggtcttgccgaactaccgagatatgttcctaacgctcttgaagtcaaagcctcatatccgtctgccctgacaatatttaatgcggcttcaataatttctgcttttgtaaatttggcttttggtggcatactttatctctccttttactaaatcgcttgttttaaatcagctgatttaattataattgaagcccacctgaaagtcaataaggcggcagagattaattccttcagccttattgactgcttatgaaaagatgatttcttcgttcataatatcccaattgctacactttgttgtattgcgttatgcgtttttccagcccttgcttttaccattatgaacagtcagggcaaggggaacatagtgtgaaatcatataaagggataaagcgaacacattacaatgaatcctttgttttcaaagcttttgtaggattttattaaaatacaaagaggtgtgattaagcacatatataaaattgtgtgtttacaatcggatttttaataatatccccttgtttcccgccagccttttacataccacctgattccaacatataccagttgcacgaataataagaaaaatagcagattgatcggcaatactgtctttatccaatctccaaaatagattgctattgccatgcttataagtgttaccagtattgtaatcatatcccagcagtatttcttatatagcccggcaatctttatcccggtgaatgctaaaagtatttctgcacccaccagacagccaccgcaaatcaataatcttatcagccagtatataattccggtaatgacaggattggatattccattactaatctgtgccacattctttcctgtcagtataatccaccctgcaatgctctgtataaaagttgcgattgtatcaaagaataccacgcaatcagaaataaagatttttgacagtattatctgaaaaagagtagtcgatacggaataccatatcagcaaaaacatcaatgcttcatacatggctgtttttgctttatatctgcctgccagtttttctctctgcgtatcatacctttccttcgctctcagataagctgtctggttacaattcccacacttttgatagagtaccggcttttcaaccggtatctctacttttttctgatgggagagtgcatagtcccgttcctgttctgcctgtcttagcttatcgcgacattcctctatcatgtcctttgcggtgagcgttttctctttctcgctctgcaataattcttttgttttcctcaagtcgttctttaaggcttgaatgttccctgctctgttctcgctgtttaacctctcgttcaaggtcagcgattcgtcgagctgcactttcagtttcctgatagtccggtctttctggtcgagttcttcctgcatctgctccgtcagcattagcagttcttccagttgatcgtcgctctttgagtttcttaattcgttcatcaatcaaccttcctttctctaattgctgttcaagttcagtaattcgctgttctgtttctgcaatagccggttctcgctgttcaatttctgtgccaattcctgccattgctgattttcgtctgtgagtttctgtatctggtctgtcttttcttccagaagcatcaacagttcttctgtatccggtaagatttgtagcagctctgacaattctttctctaattgctgcaatcgttcttcctgctcctgaaagcacatcagcttctcgtccttttcctgtatctcctgaagcatctctgccatgatattctgctgttcctctatctgtgtaatcattgcttccatcatgggaattacttctttgctttcttctaatgtcattcaaccactccttccatattgacaatgcaccggataccttaccaaaggttgtgattaccttttgcagtagtgcattttgttttttaatcatctggttttcctctaccttccatgaaccattccatatctgtccggtgagatatttttcctcaatctttcttgcatccgcaccctcatgaatcgtagggatttttaatttgccctgtctttcataagagcggtggtcaatctgattgtctatggataaatgccggttacacatcctagcccattcgcttcgccataactcacaattctttggatcattccagccggtagcatcggtcagaacccgtttccattgttttctgtttcttgccccgactttctgtactccgttttcatcaagtaccggaatgcggattccatgccggtcaggatttttcttatcctgccaccagtccgggtgggattcatcaaccacgatatttccgtcagtatctctgacaaaatcccagtccttgacttctttgttgccccatgaatgatccggattgaatggtcgcatggttacaagtaaatgcacatgtgggtttccatcacccttatcgtgtatgctccagtcggcacacattcccttatctacgaaagttttttgaatatattcggttgtataatcaatctgttcctgtctgctccattctttcggtaaggaaaattcaaatgagcgtccaagctgtgcatctgcatttttttctatcttcaagacctcattccataaccgctgtttctgaaatgtgattttaaatttttccagtgcggcttctttatcgtccgctcttttataacggatagactgttgaaccctttttatattttcttccggtacatgcagccattcaggaggtgcattttcgcacatcatcagactggtgtagacgacttcctttttggaagtatagtaactgattctgcctgtttcctcattcttcatcacatctccattaagatatgccgatgcggatatgacagattttcctttactgcgcccgacaatctttactgtaaagtgaaatatcgccatgatacgattccccctttctgccgtatccggcattgatttccgacagcatcttcttctggtttggcagaagtgaagctgtcggaacgccctctgcgcaagagtgccccctgcggcatgagcaggtctggctgaaagccccgccgacggaacgcgcccggcaagcgtaagcgcagaccggttgccacttgtggcaaacttataaggacgacctctggttgtccataagtgcgcccttcattcaaaggcaatgaagggaatggaaaacccactccctccgccattacacttcctccatgtctgtaactaattctttctgcatcgcttttgagaaaaacttcccgtttgtttcctgcctttttaagaatcctatcagctttggtaaatcttcctcctcaatcggacagccaagaaccgattccaccgctcctccaatctgacagagcctgtgggttcgttttttactttcttccgctttctttctcttttccagttccttccgctgtgctatgagcttttttgtagcttcaatgctttcctgttcctttttctctaatgcacgtattctttcttcataagtctttgttgatttcgccatatcgtcttcatcctttctttttccgataaacaccagttcccggttgcatatcaggagaagcacatggtataatcctcttgcgtgtaggtatatcatggcttcggtctgatagaacctttggcggtttcgtaggaagccgcctttttaagttgccacatttcttgtgacagcttttacattccctttatccctcagatctcgcccctcgttggcttccatgaacttttccagaatgtcagttttaataaggacttttcttccgacctttaataccggaagcttcttccattcaaccagctttctcaaagtgtttctgccaattcctgtatagtcggctgcttcctcgatggataatgcaatctttctttccgtcatcttgtcacctcctcataaattgcattatgcaatttttgttgtgctgttagtatagcggttttatattgcgttgtcaagcgttatgaaattttaaaaataactattaaattgcacattgcaattatgtacggtacatgctataattcatacataccgaaaaaggaggcaatcagcatgaaagataaagaactacgcaagctgataggcagcagggcaaaacagcgtcgtctggaattaaatctgacacagccttatgttgcagagaagatgggagttaccgcttccacaatcctgcgttatgagaatggttcgattgacaataccaaaaagatggtgctggaaggtctttcagaagcacttcatgtatctattgaatggctcaaaggggaaaccgatgaatacgaaaccgatattacggataagaaagaattacagattcgtgatgcaatgggcgatattctcaaacagttacctctcgaccttagtaaaaaggaagatgctttttcaaaagatttactgctgttaatgttaaagcaatataacctgtttctggaatcattccagtttgcctgcaagaattacaagggtaacacgaatgaagcggatattgcaaaggtaatggggtttgaatcgaatgatgaatataacgagattatgtttctccgggagatcacccatactgttaatgcctttaatgacatggcagatgttgtaaggctctattccaagaaaccggaagcggcagaacaaaggcttgaaaatcttttatcagaagttttgtatgaggattccgattcggtatagaacgacaaccggagttatgatatacttacacgcaagaagcatttcatcagttccgattgtctgatatcgaaaggagacacacgattatggcaaaaggatctgtaagaaaaaaaggaaagaaatggtactaccgcttctatgtagaagatgcaagcggcaatctggttcagaaagaatacgctggaacagaaagcaaaagtgaaacggaaaaactgctccgtcaggcaatggacgattacgaaagcaagaaattcattgcaaagtcggaaaatattacagttggagaactacttgatatatgggcagaggaagaattaaaaaccggtacgctcagtaatgggacagtccagaattacctcggtgctattaccaatatcaagaagcatccaatttcagaaagaaagctgaaaaatgtaacatctgagcatttacaagccttcttcgatctgctttcctttggtggcacttatcccgatggttcagaaagaaaaggctacagcaaagattacattcgttctttctcggcagtattacagcagtcatttcgatttgcagtatcaccaaagcaatatatcaccttcaatcctatgcagtatattaagctgaaataccagacggatgaggttgacctgttttccgatgatgacatggatggcgatatacagccaattccacgagaggattatgaaagactgattgaatttctacagaattacaatccaccggcaatacttccaatccagatagcttattatgcaggacttcgtatcggtgaagcctgtggtctggcatggcaggacgtgaatcttgaagaacagtgccttacaatcagacgcagtatccgatatgatggttcaaggcacaagaatatcatcggaccaaccaaacgaaaaaaggtaaggattgttgattttggagatacactggcagagattcttcgcaatgcccgaaaggaacaacttaaaaaccgaatgcagtacggagaactttaccataaaaactactacagagaagtaaaagacaaaaacagagtttactatgagttctatcatctggacggaacagagaatgttccagaagattataaggaaatatcctttgtctgcttaagaccggatggaagtctggaactgccaagcacgttaggaattgtttgcaggaagattgctcagaaactggatggatttgaaggatttcattttcaccagttgcgacacacctacacaagcaaccttctggcaaatggagcagcaccaaaggatgtgcaggaactgttagggcactcagatgtcagtaccaccatgaatgtctatgcacactctacaagaaaagccaagcgggaatctgcaaggttacttgataaagtggcaggcaatgactaaataaaactttcccttatttcccttacgattatctcataagggcaaaaataagggaaaatacatatcgtttcgctaatgcacaggctggaaagcctgtaaaatagggaaagttagaaatatatttcggcaaactggaagttgttgatttctttattatctaatctgttagtaatctatccaacagcatctgcctattatttataaacatttctgttacctggtaactctctgtatcctcatattcgcacagatgtatgcgtccattatcaaaacaatagatatctgcatctggtattcctaacaaaattggcgaatgcgtaactataataaactgtgctccctcttttgcacatctgtatatttgcatcaacaatgtaagctgtctctgcggtgataatgcagcttccggctcgtcaaaaagatacaagccatttggattcatattattctgcgctaatgcgagaaaactctctccatgtgatttttcatgatatttagcaatatctgcatattctacttcctgtgttgcaacattataaaagctttctgccctaagaaaatatccccacttttccttccgatagcctttggcaattcttatcgcatcacacaactctgaatgtgtatcatgcgtagaaaaaacataattctttgttcctccctcaggattaaaaccatgtgctacggcaagtgcttccaacaaagttgatttaccactgccattttctccaacaaaaaaggtgattggtttattgaaatcaagtttttcaattcccttaaaagcctcgattccctttaaataactatcgttatcaattctattccaatcgaatattactctttgtatgaattgattattcatttaattcggcctcaatttcttcaatagtaggcatactacctctgaactcttctggtataagttttgataactcataactagaaataccaagtggctggctagtagattctaatgcatattgggcttctactttatccatatctttacaaatcagaagtcccaaagtaggattatcagcttctgttttcatctgatgattaacagccacaacataagttcccaattgacctgcataagaagaatcaaattttcctgtctttatttctacaacaacataacaatgcctttgagtattgtaaaataacatgtctataaatttttcagtatctcctacctcaattctcacttccctgcccatataagcaaagccagtacctaactccataaggaaattattaactttctctataagcgcatcctttaattccttttcatcatacctttcacgcaaagtcaaaaaatcaaaattatatggatccttcgtaattgcttgtgctaaatcgctctgttctatcggaagtgtattagaaaagttagttattgctttgccttggcgttcatacaaatccgttcctaagaaatttagtaaaacatctcttgaccaattgttttcaatagtttttctgatataaaacaatgcctttgcagaatttcctttgcatttatcaagtattattttgttgtgtccccatggaattctaaaaatgatttgtaaattatccccaacttggggacgatttgcatctgtaatcaattcgtcctcaacctgaggacaaattactgcatcaggatacatctcataaaagtatctcatatatttcaaattagttggagaaaacgacttcacatctggcaaaatggatttcaaatcgtcactcaccgttttatagaatcccattccatatccgaactgttcacgcatagatgaaatgcccttaccaagtttccaataaaatcttagcatctcatcatttatcttcatagaagccctgatttggctttttctaaaatcagtggatatttcggcaatccactctttatattcattatcagccttaatcaattcgctcatatacaatcctttctaatgtgtcagttatacaaatccctatttatttatctgtactcaacgatttcttcgaatggtttcctcggtcttttgtccggagcttcgtcggcaaagccaaccgcaacaattcctgtcaaccagtttatctttttctttcgatctcatctggcttatattttcttatacttcttctattctcaatttctcttatcatagatttctctctcccttagagccttgccctcaaggctcattttctcctatgatttccaacctatccatcccaacatgacatttcagggaaagcacctcaacacctgcgtcctttgcctcttccagtgcaatgccaaattcgggatgcattgccgtattcggcctgacttcactgatttcctccatttgaatcacaaatgcaatcaagcatttatatccttgtccgcacgcagctgcaagttcccgtaaatgcttaactcctctttccgtcggggcatccggaaaatatccaactccgtctatctcaagggtgcagcctttgacttccattagatatttttgctttcctttttccatatagaaatccatccggctgtttccaaaggcatactccggtttaatacaatcatatcataacgtgtctttcgatttggattcttttctatgcaatcttccaaaatcacttccgcccctggcagcagtaattcacgacaacggcccgtattctttacatgaaccaattctacctcttccgctccgtcaatctttacacgcgcaataaaacgattgggacgttctatgaaaaatgcttccactatcttatcatatttcatgtgctgtttcctattctcttatcattcgatagaatgttccggtaccaattcctgttgtcaactcataagcttgtccatcaatcctaaatcctgctttttgatagcactttaccgctctgatattccatgtacgaacttccagatacaacggcttgttaggatataacttttttgaaatctcataagtaatcaagagcattcgttgaccataatgtttattacacaaatcaggatttacgcctattccaataaatacctcttctttttcctccaatatattgacaaatcctaccaatatgctttcatcccaaaaaccataataatttttttccctttggggattcatgaatcctatctgtcgaacttgcatttcttcataagaaggaagattatacaaatcgtattctccgccatatttccatgcacatatttgtcgtttttcatcttcggatagatttctatatactaattcattcataacatttgcctcgtcgaacttaaagttatcagtctgtttcatcttttttatagcttttattggatcttcattaggatgtgtggtatagaaaaacgctttggaatctcaactcacagcagcaatgttgaatcagtcctgctccagctttacctgctcacctgtgtctgcctcaaattcctctagctgcttaagccaatattccttatctttatttgttatcattcttatgactttacatggatttcctgccgctatcacactatccggaatatcctttgtgacaaccgaccctgagcctatgacaacatttgaacctatggtcacacccggattgatgaccgtattgccaccgatccatacattatcgcctattgtaaccggcttgccaagctccacaccggtatttctgatcatcgcatctatcggatgacatgcacagtatatattgacccttggtcccagaaatgcatgatctccaataatgacatcacactgatccagaactatcagccctgtatttgcatagaaataatctcccacgtgtatattggttccatagtcacaataaaaaggtggctctatataacactcctttcccatgtgtgcaaataattttccaagatattctccggttcttgtcatagtctcagacctcgaagcactgttgaacttatctaccagatccttcgccttaccctccggatcccaatccacacatctgtataatttacttgctttcattcttccaagcattttctctactctatccatagcattttctcctcgcatttataatatttactcatcatgtttataactgactaaaggataccattgtttatgtctgtaatcaacttctagcaacagaaaaatggactgtgaaaataggcccatttttatctatcttttattaatacacataaaggtacattccaaaccaatgcagcgcagcccccagcatcacaaagatatgccagataaagtgcatccccttggtgtccttcacaaatggaatcatgccgagcgtatagacaataccaccgcccacgatccatcccaaaagcggcttgtcatttctgaaccagtctggaatgaacatgatggcgctccatccgatgacgaagtacagcgtatagtgtatcggtcggaacctgcctggtccgaacacacatatgatggtgatccccgctatgataagcgcccactgcacacagaacaacactattccaagcacattttcccagtacacaaggtacatcggagcaaatgttccgcctatcagcagatatatcgaggaatagtcaaatcttctccagatacgcttgactgctagcccggatttgtatgagtgatacagacagctcataagaaacatcaatatcagtgatattccataaaaacacgatgccatcactttgatccctgtgtctgacttcaggagaagaaggacaaagccggctatggcaagtcctgctcctattccatgggtgactgcatttcccacttcctcaagcacggtgagttttggtggctcattcagttccctgtagtgctgcctttttgctctttttgcctctttcttctcttcttttcttttctctttgtccagctcagctttctgctgagtgctcatatctgattccgagttctttatttctgccatatttaatcctgaaacttctttctatctataattctatctataatttattctgctatctataatctacactgtcttacaaccgcagtttcctgcaccgtacagagtacagccctgggttcatcatcgcagatcgctaaagtgcctcaaacacctacacgctacgtatcccactacaattactataatatacacaaaatttgataaaagagcaacaagtactcccatgctctgcttcagattcgagattcttatccgaaaatgattattgacagaaccaaacatccccaatatagctatgaaggaatcgaaattccttccagctgcataaaagaaaaacgagacgaccaaaatattgactcttcttattctggatgtttctgtgatatacttatatggggtcgtatcagaccggaaaggaaatattatgttacaaaaattatatgtttttttcaggaaagaaaccgttttgtcaattgcagtgatcctggcgcttctttctatgttctgggtcagaccggataaggcttattttacttatatcgatttcaggactctcgggctcctcttctgtttgatggcaattgtagctggtttgaaggctgttggtgtttttgatatacttgcccaaaaattgctgatgggaacatcgggaactgtaggtgtgatcaggctgttggtactcttatgtttcttcctgtcaatggtgatcaccaatgatgtggcattgattacttttgttccctttacactgatcattgtgcataaactgccaaaggaactgggcaattactggcttcttaaaatagtagccatgcagacaatcgctgctaatctcggaagcatgctcacaccaatcggaaatccgcagaacctttatctatatgccagagcagggatgtccgcggcagaattaataaccctgatgcttccctattccgccacagcacttatccttcttctgatatggatacaggtagccgctgccaaagcacctcacgtatgcggttccgaaaaagataaaacttttttgggattctctgacagaaaagaacttaacatggaatacctggtcgcttacctgatcttatttacaatctgcctgctcactgttgcacgtatcattccataccagattcctcttgtattggttcttatatatatgctgctaagaaacagggaaaatataagcagggtggattactccctgcttgccacctttatcgcattatttatttttatcggcaaccttggaaggattccgcaattcagcagttttctggaaagaatcatggcaggaatggaaacacttactgctgttcttgccagtcagattatgagcaatgttcccgctgcgcttcttttatccggctttacagataattaccgggctttaattgtcggaaccaatattggaggtctcggcactctgattgcatccatggcaagcctgataagtttcaaatatattgcaaaagaaaacaggaatctgagagggaagtatttgggaatatttacagcctcaaatattatattcatgatattcatgatattcatgttaatattgtatttttttcttagataaaagaatagataaaatgttgttatacttgtatcaacaaacataaggaacaagtgcacaggttcaattgtaaaagaggtagtatatgagacagattatttttcacaaggaaacaaaaactttccatatattttaggtgtatatgctctgtatgaacgtttgacaaatgagtttccagaagtattatttgaatcctgcgccagcggtggcggaagatttgacccgggaatgctgtattatgcaccacagggatggacaagtgatgattcggatgcaattgagcgtctgaagattcagtatggaacttctatgtgttatccgctcagcagtatgggaagccatgtgtctgttgtccctaatcaccaggtatttcgcaataccccattacatacaagagcgaatgtagcatactttggaacttttggatacgaactggatctcaacaaattgacagaagaagagatcaaagaagtaaaagaacagatcacatttatgaaagaataccgggaagtgttacagtttggaacattttatcgtctgaaaagtccattcgaaggaaatgagacggtatggatggtgacaaatgaagaccgcacgcttgcaatcgtaggctactatcgtgttttaaatggagtaaatcagccgtatagccgtgtcagattacagggattgaaccctgatatgatttatgaaaatgtatggaaccatacagaaaattacggagatgaattaatgaattatggattgatcacatccgatgcgacagctggtgaagtacctgggaatgtgactccttgtaccgattttgaatctagaatatatatgctgaaaggcaaaaaagttcagtaggtaagatagaaaatgacgaagacaaaaagtggacttccagaataggcaatattccatcgcaaaacaggctgcagaaccgcctgctcttgatatgcgttttagtaactgttatatataaacaaagggcgaaaagctgatttttcaagcctttcgcccatctttatcatagaagaatctaatttacagacttttcttcatagtctcctttctacaaaaaagctgtgaaaaaataaaaacttcttactatctcacagctttcttttactacttattattttttcataaaatggtacagtctgctgaccgcatctccccagaagtctttaaacagatatccgcctttcatcagaatttctcctgaatagctctcttctgttccttctaattgatagattgcttttggatctaatccctgcagctttaactttctactcttattattcgtcataccgcgtacctggacataagttacaagtgcttcagatttatccttcgcgacttccatgtagcaatcataatgaccattttcagagaaggaagcgattctgtaataatccccctctcttacaaggtcattgtacttatgatacatttctgtctgttctttgatcattttacgctcctcttccggaagctttgtaatatccagttcataaccgaatgttcctgcaagtgcaacatgtcctcttgtttcgaatggtgttattcgtcctacggaatgattcggacacacactaacatgcgctcccattgtagacagcggatagataagtgcagttccctcctgaatctccagacgctctactgcatccgtatcatctgagcaccagatctgtggactataatataacattcccgggtcaaatcttgcaccgcctccggagcagttttccagtaacaaatcagggaattccgtaatcaaacgttcctgcattttatatagaccaagcacataacgatggaataattcctgctgcgaatctttgtcaagataactgctgccaagatcacttaactcccggttcatatcccatttcacatagtcaatcgacacacttcttaaaatctttgccacagattcatatgcataatctataacctccggattagaaagatcaagtacatattgctgacggatctgtgttgctttacgtccctcaatatgaattgcccactccggatgtactttataaagttcagaatccggtgaaatcatctccggctcaaaccagatgccaaatttcagtcctattttcttcacttcttctacaagatgcttaagtccgccattaatcttatcttcatttacaaaccagtctccaagtgaacagttatccgaatttctcttaccaaaccagccatcatccataacaagcatctcaatgccgtcttttttcgcttctcttgcaatatccagaagtttctctgtattaaaatcaaagtacgttgcttcccagttattgatcaaaatcggacgcttctgatctttgtatttacttctgatcatatgctgacgatagaaatcatgaagagatcttgtcatcttcccaagtccttcttccgaaaatgtcagcacaacctccggagcctgaaatgattcaccacctcgtaaattccagcagaattcttcctgatggattcccattaccatacggacagtatcaaactgtgtcagttctgcctgtccgatgaagttaccagagtatacgaaatgcattccatacactcttccctgctgctggtttgttcccggcgtcacaagtgctataaatggatgttcctgatgtccgggttttccttttgcagatgatacaagctgctttccataacaaattacccgacgctggatatgacgctctctgccccaggagccatgaagtgtgagcagttcaaaattctcattatccatatccagacatgcactgtaaactttctcaagtcttacctgctgttttcctgtatttactattttcacgcttcttgttattacatcttccttttcaaatgctgaataggaaagtattaatttcagatttaagaccggatcaacacaggtaatctcaagtgtagtgacgtcctctgctcctccaaaagatgccggaagcccatccaatgatggtttccccgtcttaatttcataagaatcgtaaaagaactcacttcccatacatcctgcttcatttctgacattaatgcagctttctctatagtctcccactcctccggacggatattctgtcggaaagtaatctaaaaatgaagatttttcacgttcatttacagatggtgtaaacggaggttcttctgttcttaacaaatagtacgcatctgcatcctccaaatattctccataatatacatgcccaacatatccttccggtgaaataccgatcaagtatgatgtattttctgtatccagcttaaagattcttcttgtttcattatatataacagacattttatgccctcccttttgtcatagctttctcaagctctttcagtttctctgccgcatcttttcttatatcagctttgtaatcacgcactgtaaatgatattttatcttttgattttaataagtgctgttggtgattttggcttaccatccctatatatctcccctgatttcataagaggatttataacctcatttaggaattggcttctgcttcggtagttaagagacatctgcagttccttaattggctttggtccttccatcttaagaatagccagaactttttctccatcagtaagtccttccaaatcaagttctataacttcatccctatataatctgtcgaataatttcaaattcaagaatcccggatatatagatactaccggttgaatttcatcaggacaggctttgtaggattcaatcatggtttgaaaaccggttccacctctctccatcagatttgccacatccaggcaagctgctatgatagcatttcttctgatagagggtattgaaccagctggatatgcattgtaatctttaggcagtaaccatgaccccggtgaaactatttctattctgtctgagtatatgtcaacatcaatctgtgttcccgaaatagaataatccctatgggcaatagcatttaccaacgcctctcttacagcttccttaggatatgatctgatttcattccgtccgccattttctgtttttacccagcctgtttttgtatttcgttcaataaagtttaatgcatttgtaaaaacatttgcaatagaccccctgaatctgttgctatctaaaacgatacctgtcttgtttttacctttccacaaacggcagcatatcattgtatcatcttcactatagttgtctgaaaacattataaatcctgattttgcatacccatcttttgaaactatttcttcgttctgcaattcttttattgttggagcggatttatcttgtctgtattccttacaaagattaaggtattctgaccactgattatcagtatatgccacttcgcttgtctcattatctacaccatattttctctttgaaagtgagataatttcttccggtgttgcaggagtcgcatttccatctccctttataaaaactgtttcattgtaatctccctctctatatcttattacagagtctgctggagcaactttaacggctagtacaaaatgttctgcattagaatccacgctccgcatcatatatgaaatcttaatatgtgggaaaatatgtctgtcattaatccttgaaattagcagttttgttttatcaacttcttcaaggtcaattccaaaggcttcaccgtcgtttgatacccctacaaataaggttccgcccttatcatttgcatatccaataagagtttttgcccatttaatcggactatccggatttaacaccgctttatattcataacttgtatcttctgtaataacatctggatatagctctctgattttcatgaatctcctccattaacaatgttcttaacataactatatcaaacattactaaacattacaataacattactaacacattatatacggaaatacacaggcatttccatctaattaaagtaaaatgaggattcgaaacattatatgacattactcagacattacaacaacattacttatatccatttgctactttgaccgcctctttttgtcccaaatattgtatattattcgtggtatttttcaatagacactaaaagattctactattcatgcttactgaacaagtgttgctcactttttaaaatatactgataagccaatagatactatatttttttgcagttttttccaaaaagtggtaaaaattattcctcttcaacaagtttcacaaaatcatctggcagaattatctttgttccacctgcctgataatcttttatatttcttgtgacaatataatccatatcttttctggatgccaccttttcaacaactgcatcctcatagtcactgattgcagatgcaagtgcatccatgcagtcatccgcagtaacctctaatattccagtcaatgaataaagctttcccattatcatctttgctgcttctgtgttatgcaaatgtttccttataagataatagatgtctgttgctgaacttgcagtaatgtacatttcgattgtatgatttgctgccataagaaatatttcttctgcacttttattccatggctctcttgaagtcagggcatctattatcacatttgtatctgcaagaatcctcatctattttgcaccaagcctttcttcttttgcttcattcaggtctgcatcctttggtaagattccaaacagggattttgctacttctactctgtcctgatgtggatttgtcagttttgccactattttcccattctttgtgataaaaatatcttcttttgcagataataataaatattttccaagattatttttcaattcagttgctgtaattgacatatcaccacttcctttcttcgtactattattatactcattttgtacgattttatcaatgtatttagccagaaaatattattcttcgtctacacttacattttttcgattcatccacaaatagaaaatcacattaagcacaattccctgaatcataacccagaccgtcttatcatgaccgttacagcatcttcaccttttacaagattttgtgtgattatttgtttttgtttttctaaaaaaaatgccatttcaccacttttatgtgatgaaatgacatttttcagtccatttatgtagttcgtcacaatatttattcctgcgttagcaggtaatccttccatatctgtgacatcgattaccacctgcttatgatttgccttgatttccagtgttgtttattttcctttattaattggcagccagtgctgccagcttctgcataattgcacttacatcctgcattacattcaaattttcttcctctgcctgcatcgtctcaccagcgtgcgccgatacctgctgggaaatcgctgagattgtctgaatggaatctataatttccttatttgcattctgcaactcggaaatgcttcttgaaagagtatctgcatttttctgaattgcccgcgtattgtcctcgatactctcaaagctttcttctgcatttgatgcaccagtcttctcttcgttaattccatctatcatattggagacaacaccgaccacctccatgattgcattggacacgttgctgatcaactctgtaatatgtacggttgcttctttggttctcgttgccatacctgaaatttctgttgcaacgacagaaaatcctcttcctgcctctccggcacgggctgcttcaatgctcgcattcaatgcaagaagacttgtttggttcgtaattcctccaatcagttctacaatggaattcatttcatccatatactggttcagattttccagtttttctgtaacctcggttccattattaacagaagcttcaacttccgatgccaggtgctcgatatcctgtttgccttccgctaacgctttcagagtaagcgtcatgctgtttccgatttcttccacagcggttgcaacttcatccaccttatcctgaattgcatgtgtctgttccaactgattctgcacatgttctgcagtatcagtagcacctgcagatacttcctgcattgcctcagtcgttgtcttagatgccgctgtcagcttttcgaaacgtacattgatatctgcaatattgccggaaatctgctgatcaagttcctcatttctttccagaagattttcagcctctgcttttgcctgcgccacttctgtaaatctctttcttgtgttttcgcgaatcacttttgtagtcaaaacagaattcgctccaaccataatcataacaacaatctgtacaactgctgcttcgattccatgatacccaaaaccgccttttgtcgcaccgatcacaacaacaatgatactctctaatatggtacctgtattaatcagaagaagataacgtgtgtcactgtaaatggtgacaacaaaaatcatcggaattacaaatacataaatcagatttgtcggtgaggtaaaaagacatattgtgtaaaacaatgcaaatccataggaaaccagatgtttgatcatcgcatgttccgtattacctttccaacaaatcacctcgccaatcaaaggtataacaccaacgaccgtagcgattgtcatatataccggagacagttgtcctcttacgctttcccatatcataaaaaataccataaccgttaccgtactgatatgtgacagcatcgcaatgcgattcgaccgcgtcaattccgaaatttcttttgtttccaccatcataatacctcctctagaaaagttttcctacttatccttatattatttcttacgcatcctgatattctatctttaatggtgtatgtgtctcaaatacctttgcaaaatcaatttccggattaaacattgtataaaatgaagaatgtgcatcacatgtaatattctgctgcggtacagaatttaatgtaccatccttattatatttataaaatgtagcctccgtcactccatgtatctcaaccttgtataatggtgttctagattcatgctttggcacatagcggccttctttaaactgcaacacgtaattcggctgttccataggttctgccatattgtataaacctccctctccattcacttttgtcctttataacataataatctccattattttcaacatcattccacgctgacgaagccttatcgcaaactgtatcaaacagtccggggcttagcttaatcgttaaataaaagcaattattttatataattttagattactttagtaaatggcgcaataggtcaaaattaccattaatcagataatttctgtaataaacaagtgtgtatgtcagatttttatatattcatcgtcatatatggtggaatgcatataattccatcttttacaattaaatttcttggatgaataatataactttcccctatgcgctccttgtatttttctctgaaattatttaatgaggttgttttatattgctttccagactttacttcaatcggaaacatcttatattttaatctgctattatttgaaatgataaaatcaatttccatatcatttcggtgcttattttcattatagtgtgtataaaaatataacttatgtccattcgccaccagcatctgagctattgcattttcataaagcattccttcattaatctgtaatttgcctgccaatatctgtttatatacttcatcttcaagtaattcattctcatcaaatgcatggcttaccaaaagtccggtatcacccatataacactttacatagcttcttgtctcattcaatgataagccaacattcggatcattacacaaaaagcactcattggatatcatagaatccgacagccagaaaaaagtttcttcatactggtctgcataactaccatcttgtagctttttgaatacaactcttttttcatgctgtgaaagaaatcccggaatctggtcatagattgcaagaactttgcttctatatctcatatctatcttcataatatcttcccgatacaatttaagaatgtcccttttttctttatccggttctgtaaaatcttttttactttcaataaatgccactacaggcataggcatcccaccaacaagcatatactgatgaaacaaaagcattgcctgattatgcatacttctttccaaaggttcccttttttcaaagcatttttttatatattcaaccagcaaatcttcttctaatgctattgcaaattcttcgaaatccaatggatacatattgatatttctttcttctgacggtatgacaatattctttacattttctctgatagatatcaatgagccagtttcgatataatcatatcttccatctgcaaccaaatattttatcgcagctcttgcctgtggaaacatctgtacctcatcaaaaataataagagagtttctctctgtcagttttgttccaaaatgtgtctgtaacagcataaaaaatgtatccagatcattcagatatcgctcaaaatacctttcgacttccttatcttttttagcaaagtcaatcagaagataactttcgtattcgttttttccaaattcttcgcagatggtagactttccaatacgtctggcgccttctatcagtaaagctttttttccctgacattcatttttccattccagtagttttttatatatttttctttttaatatcatggttcctccagattatgcgcatatatgttagttctaatttttatgattatacgcacattgtaattcattttttgattatacgcaagtattataaccctatttttttatgattatacgcatattctataaagtcatatgttcatacttttcctcatttcaaatcataaatcttacctgattatatcgggaaaagcattttatattatatactgtgttattaattttctggaatttgcgacgattatatagtactgattctaaacggattttgaatttatttggatagtgattaaatgaaaataattaataatcttagaaaagcatgtattaccagtaagacctgctcgaaaagatcctcgcaaagtcaacccccaggcatctgtaagctttctatatagagtggcttaatcatagataattataagttttttttgacagatatacaatctgtctttttgttgtgctgcaaaatagacaaaagaaaaaacacatcatatttatcaaacaattgcaaatatgatgtgttttataattatgtcaaaattcttaacttaatgacattgccctttcgagctctttttgatttgtacaacattaaattgtagatgattactgtaagagtgaaagtacaccctgatttgactgattagcctgtgcaagcatagactgtccagcctgtgcaagaatgttgttcttgctgtagttaaccatctcttcagccatatctgtatcacggatacgagactcagctgatgtagtattctcaactacgttgtcgaggttgttgattgtgtgctcaagacggttctgaacagcaccaagtgctgaacgctgtgaagatactgctgagattgcatctgcgattgcatcaatagcgtatgtagcatcctgctctgtatccgccttgatacccttaactccaagtcctgctgagttcattgagtcgatgttgactgtaatcttgtttgtcatgtcagcatctgcacctacgtggaggttgaagcttaaggcatctttgtatgaaacagttcccttggtaaggctgaatgttgtggttgctgcatcatgtgtagcgtttgttgcagttgtggctgctgtatcagctccaatactacttgccttaacgatttcagcggtctgtaactgatatgcttttccggcagtaataactgttgagtcattgtcatcaataccatcggcagcgccagctgcatctgtcatggctgtatatgtttttgttccaatagttactgttgaaccatctgtaactagagcctttaaatcatcaagtgtagcataagctgtatcaccagcatttccagttaagtcagatttctttaacttattatttccagttgaatcaaacacctccgtatcgcttacctgatatgtttttccattaactgtgtatgacttctttgcagtatttgttccagctgtaattttattctgtatatcagtagctgaagaaccaattgtatagttcttaccagcaatgctaaccttatcgccagccttaagctcttttaatgtaacatcaactgtatcacccttatctgtgagtgtaactccatcaagtcctgcatcatgtgcatttactttatgtgccttctctactccgtcaccctttaagaggtatgtctcattgaactttgttgtctctgatacacgatcaatctctgttgtaagctggtcaatctcgtcctgtattgccttacggtctgtgttagagtttgttccgtttgcagactgtgttgcaagctcattcatacgctgaagcattgagtgaacctctgtgagggcaccttctgcagtctgtactgctgaaacaccatcctctgcgtttgttgatgctctgtcaagtcccttgatctgctttctcatcttctcagaaattgtaagtcctgctgcatcatctgctgcacgattgattctgtaaccagaagaaagcttctctgtagatttagcctgctgacctgttgttacgttgagcattctgttggcatttgctgcctgcatgttgtgttgtactaccataatataatcctccttgtcccatattcatgggttattatgtttgacctctggaaatccttttcccgagggttttgcagctgctttgtgtatatttttatttaagcagttgcggttttctataacaagcggcttcccgggtgtggcagatgccacagccgcctattaacatgattagttgctttgcgtctttttctgacgttctttctcattccagataatttgcttgatttgtttctttgcttcactggaaaactcaggttcgggataatatgtatcttttcgcttcgccgggtccggttcgttgttggatcttgcgatattcagttctttgggagcatctatcagtaatcgacaatgctttcctgttccacccgcgaacacgattcggatatcatctccgatatttacatattgcccttcctttaatgataatttgagcattttctacctccatgcactaaggaatagctttgtccatgcttttccgaattatgcaacattttatagtaaaatgttacattttttgctttacacctactatatcggacaccatttttagaacttaaccccaagaaaaaaatttttttaaataattctctttacctttttctatcatttttaattaatctcactggattcaactatatcacgttaaagataaagtaattcttgatgaaatatgactaaaccggcataaatatttgatgttatttaatcaacttttgttttgcccccttattaatctgcgaaaaaatgtaacattttactataaaatgttgcattttttgctttttataattactattattttgttgttgattttggatattccagggaagagtctgtcatgcggcatgtgcctgataatattttctaccgcaaaggagtattcaatgggaactacacagccaatccgaaataaggatgaactggcggctttcaggatgtattataaagatatccatccaaaccgccgcaattactgtttaattgttatgggattaaacacagcactaagaatcagtgacctgcttaaattgaagtgggataacgtatacaatttcgagcaccatgtatttcgctctcattttcttatcaacgagcaaaagaccggcaagaataactatgtcactctaaactgcaatgccaccgatgctctccggacatatttcaacgaacggcatccgactgaacatgagtttatttttacaaaggccacctgcaggaggcagccactaaacagagttcaggcataccgaattgtaaggactgctgccgaggagacagttcaggatgaacatatcagctgtcactctttgagaaagacatttggatatcacgcctggaagaacggcacaccacctgctctgctgatggacgtctacaatcactcgtcctataaagtcacacagcattatctgggtattgagcaggatgaacgtgatgagatttatctgaatcttgagctatagttttatgcgtattgaaatctaatatagctaaaagccagccgtttgcaaccggctggcttttttggggatatacaaatcatcgaaatcctctgttaaaccaaatgcattctgttctgaatcgaatttcaactcaatctgtgacatatctttcatctgcctggtactgttgtattttaaaattaaatttcatcttcagcaccaccttcttcctgtaaccattctttcaatttatcctgtaatagtttcttatccggcagatacagtttatactgtgatgcataaatattagaatcctccggcaatgtcagttcaaccatcgcatcatttttttcattgcacaacaatacaccaatggtaggattttcttcctctgttttttcgtatctatcatagtaattgacatacatctgcatttgccccagatcctggtgctttaatttgccaatttttaaatcaaataatacaaagcatttcaacagtctgttataaaaaacaagatccactctgaaatgatcttcttcgaatgaaaatcttttctgtcttgccacaaaagtaaatccttttcccaattccaaaagaaactgctgcaaattatctaacagcctgttttctaaatcagtttctgaataattatatttatcttcaagacctacaaattctaaaacatatggatccttcagcacatcctttgaggttgtaatcacatttccttcctgtgataagcgttgcactttgtccttatccatgcttaacgcaagtctctcataaagagaagaattatactgacgtgacaaatctctgactccccacttctctctggcagcttctatctcataaaatgagcgttcatcctcattttctattctcatcaattgtagataatgagaccatgttaccacaaacggatgctcctcttcaaaaatcgtaaacaccgtttccgatttcttgattgcaaattccgtaaacagcgtttccgaaattcgatccttatatgttaaataaaactttcttgccttttccagcgtagattctgaaaagcctttgccaaattcttctgttaattttttagaaagatttattatgatttttttaccgtattcagccctgtgttttccctgctgctgtacttctacaatccacctgccaagagaataataggtcattatctggacattatttacctgctttgcagtaatgtttcgtgcatatttaattaattcaattgaattctgacataacttatccatgttgatatcatatacagattcattgatttcatccttcacacattcaatcctcctatttcaaagttttcctatttcagaaacactggctgttctgttattccgttgtaaaactctatagccgccgcaatatccttctcatccggatgcccctttgatacaccgccaatcagcttgaacggtccgaacgtatcaaatcccttgcatgaaaaccttccaacaatgttgtcatgtttgtatgctatcacctgctcaattgacttaaagacaggtctgccaccatatgtacagataagaaatacatttttattgtctgtgagattgactgatgcaaacttaagcacagactgatggaactttccgccatatactcctgatgcaaaaccgattaaatcatattccgacaggtctttctctaccgtctgtgtcgcatctatcagctcgacatcgtttgtctttgctatctcgtcaattatcttttttgtgtttccatgatgcactgatgcatatactattgctgtcttcatctttaatgctccaatcctttattagtcttcctttgattttgccatcagcatctgctcaagctttttctttccggtctcatagtctgtaaacacaattccctccataccaagctttctgccaccttcgatattctccggtctgtcatctatgaacacacattctttcggattcagattgtatttatcaaacaggcactgatagataccggcatcaggctttatcatcccaaccatagctgaaatgactttgccgtcaacaagtgacacaaaactaagttcactgtgcgtatgaagctcgaagtagtcctttggataattcgataacaaatacactttatagcctctgctctttaactccttaatccagtctgctgcatagtcgaatgcctttacgacaaaagcctttccctctttgaaaaatctcctgatatccgcctcatactgtggagccaccttaaccatctcatcaattatctcgttctcaggaattacaccacggtccagctcaacccagacaggattttcatatgttgcatgggctaaagctgctattttattttcttcaatgccaatctcacgcattgcctcgtccggctggaacctgacaagcacgtttcctatgtcaaatactatgtttttaatcatttattttttctcctgcaaccctgcatctcttcctgcaaaaagcaatgccatatgctaaaatatcgcacctgccctcatcgcgcagagcctcatcatatctcttctccttaatctgcgtcatagccgcctcacacgctgcatcaaggtttttcatctcttttgcatatttcacttcaataacgatgcctgcatccggatcctccggcttgattaaaatatcactgaaaccgtctcccgactcacgatttaacttaataagccagcccggattgcttccgcgaagcaggccgaggagcagaccgtgatagaagttctctttcatatcatcagaagcctttgtatcaagtatacttatcatgcggctcatcacgatgttaagctgtcttgcaatctgcttctcatctttatcgaggatagctctggataaaagcttcatggtatcatcatcttttgcgacaacagccttgaaccactcctgaatctggagaacaaacacttcacgcacctctttatttggaatcaccagcttgtaggcatagctctcactgtcaggcagcctgacctcaccagccgtagtcaggtagcctgttgtaaaaagtacgctccacagattgtctatagtattgtcaatctcatcataagtcagatccagtcgaagctgtttctccacaaatccacctgccacgagcttttctatctcatctctcgtggtctggtctgccttgtctacaaagcgcttcaccatgtcattgccactgctgttaatccagaatgcactcggcctggctgatgtgtcaaaaaccagcttcttggcaaaattgattacatcccacggacaataaatgtcggtattaccgaaatgatagccatcgtaccactcctttacatcagggtaacgctcagccctgtcataatccgtaagcagcttcctgacctcatcatcagtaaaaccaaactgttcatcatgggcgatatctacaatggaattgatttcaaaattgttgagacctgtaaaaatactctccttggatacacgaagacagcctgtgagtacggcaaactgcagaaactcattagtcttgagtgcctttccaaagagtcctctgataagtaaaaccatctctttatagtaaccattctggaatgccttatccagaggtacatcgtactcgtctatgaggataacagccttctgaccatagtgtataaacaataactgcgacagactctgcagacttgatacaagaagctgctcatccatcgtatatttgccatcacacagcgaaatgatagccctatacctgtccttatcgttttctgaaagagcctcactatgctccagaaacttaaatttttctgcttccctcccaatgagctcagtaatcatatatcttgcatcatcaaatgaacgtccttcagcactcttgagtgacagaaaaataaccgggtactttcccatatatttgtcacaaagctctttgttgcctgaaatatataagccatcaaacaatgactcatccgtgccaatctcaaaaaaactttttagcatgctcatattgagagtctttccaaaacgcctcgggcgtgtaaaaagggtgacctctccaccagtttcaaccaattgctctatgagctttgtcttgtcaatataataaaagttgttccttctgattttttcaaaactatcaattcctaccggcagttttaaagtactcaccatatgaacctccacaaaacgtatcaatccgctatacttagttatagtatagcggattgaggggcaaaatacaattattattaccgtcctgtgttccttagtcttcctttgattttgccatcagtatcattttctcaaacgactgtgcaaacctctcatcatcttcctctgtgcgctttttcggtcctttgatatgattcttatgtgagcttcgtctacaaatatctgcatttttttccagcctcttcaaataaacgagattatttatccagatacctgaacacctaatcactctctattcacaaatttatcccatggtgtgcgcacctcaataaggtttccggacggatcataaaatcttacaagcttctgtcctccgtcgagttctgtcagtgctgtagcatatctgacctcatccctccctgactccagctttttaactataccttcgatatcattatcttcaaaatacagttccgtcatattgttatatggaatagcctgtatctgcatgctttccttccatattccggcatcctgtaataccaggccctccgacattattacattaccttcctgtctcgaaatcacattaaggccaaacagttcgttatagaagtggattgactcttcgatattgtccactactattaatatgttctttagcttcatatgaccaccccattacaatggtccacctcatgcttgtgtcaagtaaagaccaaaaaaatttattttcaagaactatcaaaaaacgatagttcttgaaagctttcttgtataaagtatatcatttaacctgtaaaaaatcatccacattccactcaaattgaatgttgccgtcatcatacattgtgatacgctttacaacctgacgaataagatccaagtcaaatgtctccattttggacaacaactctattgtttcttcctcaccagctttattaatacattgttccaactgtattttagactcaagttcgtgaagctctatctcaatttcaccaatacgctcagtaagcgttgtcctttccgataccataatatctctctggacaattcctttcgtataatcatcatacaactgaaacttcttagcttcagccttgcttttcatttgatgcagcttatcaatttctttttgcaactcaacactactgcttcttttctttttgtatatctgcaaatgttcaagcatacctgccgctgttgtattaatatattgcataacacctgcctcaaattcttccgttttcattctgacattgcgacagttatatttactcggatcataatcaaagctacacttataatacccataagaatttacaagtcctttaccacagcaaccacatattattatagattttttatatgaaccctgctctttagttcgattacaggttgtcttattaatcactttatgtgctttctcaaatgtctgtttcgacactatcggctcgtgacaattttctactataatccaattatcaggattcatttttttcgacttataaccagtttgagcattacatgctgtctttccataaacaattgttccggtataaatctcattaaacaatatattcataactgctgtggcactccattgttttatttcataatttcttgggtgattccactttttaccatgcttttctttatattgtacacgggtatcaatgttgttagcattcaaatatctggcaatttgcttatattttttcccatcgatagccatctcaaatataagtctgaccacctctgcaggttcttcatcaataacgagcttttgtttatcactttcagacctcttataaccatatggagcctgcggtcctataaacttaccagcctttgctaatgtcgttcttgcacttcgtaccttttttgatgcgtctctgctatacatcatatttataacattttttaccgcaacctccattcctcctgttgctcctgtaaaattattactgtcataattatcatttactgatatataccttacttttagcaccggaaatacaaactccagatatcttccaacttccagataatctctacccagacggctataatcttttgtaataataacttgtatattgccttctttgacctgtgtcatcatttcttcaaatgcttctctgtcaaaccttgttccgcttataccatcatcaatatattctctaacagtataagttgaaagaactgcgtcagatttgatatattccataataagatttctctggttggtaatactattactttcatcttttgggtgactgcttttgttcccagcactagcaccgaaaatgtcatataagtatactccaatcatgaaaccaacttacctttggcaggtttgacttattaaagagtgaacttcatggattcaggtttaatataaaaaatccccgaaagataattttcttcatttgatttttttatttgagtcttacattttagatacaaattcatatcttttaattcatattgataaattattttatctgataaaatatagataacattctcattaatcgtcatttgctctacatcatgtccaagttctatattatttaactctttggtttctaagttatatatagatatacttccaccttctctttttaccaagtcaaagtgagaaacgataagtatgttatcccatacggccaaatctagtggataatattgatcaaatgaaattgtttctatcgtcttgtcatttatcgaatatatgcaaacggtattacatggatgatcaccagaatctactgagtttgaaaacaatatgttgttgtcgaaaagaattgctttataatgagtacctccataatttgtaatatcaattttctcatcaaaactcagttcttcagcatcataaatgtaaatgtaagaattcatctcttttccgtattttgtagtagcaaatgcaaataacatatctttactacacaatagcttgcttacataaacaccttcaattttctcacttacgacttgattattttctttactacatttattaatgtacgaatcaccgtttaacgtattgcaagtataaatatttttatcattaacacaaatactattcattgccaactgattgatttcatagattttttgattcccacttttcaactcaattttcagaacctttttttcatccttaacattagtttttccttgaggaatcaaatatagttcatcttcataaattactggattataaaaaatacttcctaatgaagcgtattccaatggaagcgtagctgttttttctaaattttgattataaaagtaaattctactttttttactattaccacttgtttcaataactccaacagatgaagttgttagatctatattcgcactctctctatgcgtacatccagtaaatcctagaaacactattgcacaaattgtaaaaaatttttttttcatacacatacctcatctaaaatatcagcctggaaaatttgagaaacattaatttatacacaaattttccaggccgaggtgtattacttaacgagactacttctttaatttttttaaataaatcttctggcatttgtacaaaactttcccctatatatgatgataatgtttcagtatcaacccaaacctctgtatctgtaccaataaacttaacacacatatcacaatcttcctttgtaatatgagtatttgatggctcccagttttgacggcacaaacgaattatttgttcaatttcatctggattggatacaatatattcattatcattaaatataatctctattcttgttgctttatcaaacataccatatccttctccgccttttacctttattttgctactattttcattcatattcactattaaaaaaagtataattatcgtggatataaacactaacattgtaatatacgacttgcgttttacaacagatttattacccaatatcaacacccccatctgtataactcgaattaatatttattccaacatttccccatccatcatttactgtataggttccagaattatgagatgtaaaattataacccgttacaacaacccaatgttctccatatcgtggatgagatatcaatcctaatatgcatggataatttttaccaataattgttctaattctatctccccaactatatgtatttgcagttactgtagttggtttatagtattgcttaatatacaacgataatcctctttttaactcaatgtaattagtacttgttcccattcttgcaacaagtgcatttatcaaagcaacgccatctgaagattctaaactattaggtacatatgacggtgacttatatcgatcataataattcaaaacaatggctcctgcaacagaaccacatcttccatctggattataactgtatcgtgcagtagaatgagatatactatcgctagatacagcccttgtttttattaaaaaattatcgatatttaaagttcctaatgaatcagcttctgagccacgcactagaggtgtaatatcttctatagctacttctttttgagactgcaattctattatacttccaaattgtctagtcccgtccgccttataatacattagcggaccgccataataataatgagcatctttctccgaaaagtatttattgttgtattcagaatactcaatcatttcattattatcagcatttacaataacatatcccgttgggtttaattcatagtagtatgcaataatattctcattagaatcatacaatttaatttcagaagtataatttactgaagaattttgttccattgttgtatatgcaaaagttgtaatattaacactaaaaagtaatacaaatattatttagaaacttataaatttatgctttttaaacataatgattcctccttcaccacaaaagtcaattttttctgatgtagcacacttacaataagataattatattatctttgtcataaaccatcggaaacacctcatttccttatttccttgcgtttttttaatgtttattcatagaatatagtcaatccaacaaattagtttaaagtggttattatctttctatttcaaatttttcttattatacttataataatacagtatatttaatgatttacaaacacaaattaagtttagtataaagtttttatatatatttcaactgtcaaatatacttttaataataattaactcactttatatacaccacttacaactttttcataaaaaagaaatcgtacatggctttctgatgtataatgaatttgcacaaaaacagtacaaatgaaagtgaccctgtacgacaaagacattatacaacgaaaactcattaattggtagacttcataaatattttttgaatattatgcaactttttctgttcctacggcagaaacattatttttactagtactttaaatactcgcattggagtcagctcattcaatcagattcctgtaccagcattttcttgccgtgataacagaaaaatccctgaatactttttatcatgcctgctcttatgccaaagctgattattcaagatttatgaatgcaactgccaaaatggcactgcaccttattccggaacagcttaaatcacagccggtgtttctttgcattgatgatacaataatctccaaatttggtacaaaatttgaaaatgtatcaaagctgtttgatcatgcaacgcataatggctgtaattatcttaatggacactgttttgtaagtctgatgttatgtgtgcccgtgtggaatcgtgataaaatatcatatcttgcggtgccgttaggataccgcatgtggcagaaaaaagaatcaaagcttgagcttgctgcatccatggtacgtcatgtcatgcctgaattttcatcacaaaaaaatgttatcatactttgtgacagctggtatacaaagcagaatcttgtatccattgtcaaagagtatccaaaccttgatctcattgaaaatgccagagcagattctatcatttatgatcatttatgatccttatagtactttatactgtccaataatcatcccttgtatatcgaattaatgtttagtattgcaacatatccgcattaaaaaaggacgcaggatctctcccacgtcctcgcatttatctggctttatcgtctcttaccttcggtgcttccttatgtgccgcttcctgcttcacctcatccacacctctagcctcaaatgcatctgcattatactgatactcctgtggctcagcgaccattggtgcatatacaacctctgcttctactcgctcagcttctgccctctccggctctgtctgtttctgcgctttcgcattctccatatgcttttccttatcaagctgcacatccatcgccagattatccagcttatctatggatgcgtccaaatgaatctccattaatacaagcatctttttcactgctttcataggggcaagcaccgcctttgtaatgggatgtttctgctctttctgtgaataatccacctctggcttgtcagcaaaagtacgaaatgcattggttactgtctgaccggcttcacgaaatccttttgcaagaagttctgtctttgctatatccttatccgttgtcttgattgcacctcttacattctctctgatatcaagaagtcttttcttaattcctaagaactcagacaacctgtataatgcagatcttcccttttcttttgccttatcgactatgctcttagctgtagatttgacctgtgctttcacttccaatacctgcgactttatctgctcacatctggcattaagtcgctcctgtgcttccgacaatgcctttttagcattattgataagcgtatcttcctgcatttctttgatctggttctgcatattggtgagttcttcagtcatggaatcaatctttttctccagtccatccacatagctgcatatctcaaatacatcgtttgttattcattttcttcttcctccataatctgcatattcttttcatacatctacccatacctttcggtctgttcgccttttccctcttctttgctgctgaaatgtttataagcaagttcatcatatatgcgatcaccctctgctttagctttcataaggcatgccaaacagattgctacaataattactgctactactataaatactttcatatccagccacctctctttttgtgagatgacttacattcggaccaaatcagcttcctttctgccatctcctgctcctttccaataaaaaaggcaggacaaacagccggatacacttttcagtgcaaagctaatttagtcctacctaaaattattactattcaattttcacctctcttgtgtacacaaattacattcagaatttatattctgaagcaactatgtattctcataaatttcggattttaaataacagcgctgccttatctaccgattaaatggtataaaaaatagggactaaatcagcgtgaaccccttgttttcaaggttttcttctaacttgtccctattatatcgcattcatcatgctgaattatctgtgctgtccagcctgtgtatttgccatgtttctttttgaaattctggtctagataatccacttcaatctctttatatcttgtgcatggtctcacaccctccagcgaaagacagccttcctccgtctgaaaagctcctgattttccggtaatcaccggattaatcatggcaaactggaatggtccggccgcaaccactatgatattctttttcacgccaatcatgttagctgccattccaacacaatggtcaagatttgctttcaatgtgtcaagtaaatccgtaaccacctgtttatcatcttctgtagcatccactgatttctgtgcaagaaacagtggatcacgcattatcttctttaccattatttactcccttctgtccaggtatatttccaccatatatgtctcaataagtacattaattaataaaatttcatttttcatatttagcctttcatctatctgtatcctgatacttatgataccatataaacagctttctttggcagatatttttttagattgccatgaaaaatttgaaaatgacaaacctgcttttctttccaataagctttcctaaaataggaaatttttactatcctaatactgtttaatagcatcttaatatacattacacaaaaaaagatacaggcgaacctatatctttttcgtgtaataatatgattaaggggcaaaaggtatcatcgatgcatgcttgcaggcaagtgaacctgatacgaattcctcttgtaaatatatttcttattcttcaattacaaagttgcttacattcttgcggagttctcctgccgaagcctctgctgtcttaacacctttcatgacttctgccgattcgcctgcaatagaaacggttttttgcgcaatatttgttgtacctgcagcactgtcatttgatgcggaggtaattccttcaatcgcctctgtaatattggaaattgatgctaccaattcttctgaggttgcactaaaatccgataccagatcattaattttagatgcatccatattataatcatctgccattttctcaaaattgtcaaaactcttcacaatatctgtatctacaaaatccaacagacgattagagtcatttgcaagatttgctactgcattatccacattttccgtcacggcctgaatatttgccacggcatctttagactgctctgccaatacccggatttcctctgcaacaactgcaaatccctttccggcctcgccagcacgtgctgcctcaatggatgcattcagtgcaagcagattagtctgtccggtaatcgcaaggatagaatcagcaagcacgccgatctgttccacaacctttgcctcttcaagtgcctgctccagccttcccctgatttctccgagcatcgtctgaactttctgtcgattctccaccgttgcttccttcgtctgtgctgccctcttatgaatttcttctgcttccgtagccccatcctgtgcacgtatcgcaatctctttcgctgcaccatcaatctgctgagtcatactgttgatctgttctgtcgatgcggcagtttcttcagtacttgcagcaagctgctcggttgtcgcagacacatcctcaatttccccattcagatttgatatactgctatccatcgcttccacaactgtatcaatatttgctgcctctatctttacctgggaaagcaatccgcatattgattccctcattgtctcaagtgttcctgccagctgtccgaaatcatctttccgtttcatcatattgtcctgcattctatgcgcaaaattaccacctgcaatcacttcaatctctgctacaactttctttagtgactttgtaatatcctgtgcgatcatgaaaacaagcactgcaacaatcacaagcattgcaacacatgccccaatcagtgtgattgcctttttcattgcatagctggaaaataccttgtcctgcttttcaatagcagtatcaatataatcggtataatttcctgtaccgaccacccagtcaaatggttcaaaatactcactgtaggaacgcttcggtgaaggtttagtctctccttctttaggaaatacataatctgtgtatcctccaccatcttccactgctacacgtatgatttctttcaccatcttgtatccgtttgcatcctctgtctccatacggttcgttccctcggtatcgctgccaagcagaactacatttgttccatctgactgatcaatccaaaagtaacctgtctccccgtaacgcatctgccgaacctcatccgctgcaattttcttggcttcatccagcgtataagttcccgctttatatgcgtcattaatctccgacaacagggaaataaccacgcccacctgctctttaattgaatcatcataactctgacgggatgatgcatccattgtctccaatgctttatctttcacatctcccaaatccttgatggaaacaacactcccaagagccacaagtaaaataaccagaaccagtatcagatttagcttggttcttaccttcatattcttcatatttttattctccctttcttggaactgatcacttttgtatattttacccaaaaatacaaagcatgttataaaatcagtatacacttttactatattttcgtcaatagcgatccaccttttatacgttttatctctctcaaatccataaactttgctgagagaatatgactttgcaaataaaatataaaaataagcgatattaatcttcctacgaaaaaaatcactctgattttgccatctcccttgcatgctgccttgagcaatatttgcagtaatatttgtaaatcagctcatatctgctaacattgcctataaaacaaactcttaaatattaaaattcttcaataaaaaatcctctaagacaataggtatttcttctactattgtttccgatacttctccccacgtaagatcatcaacaaaatagattacacgcttaaaacgattccacatttcttcgagtccagaatcatctttaatcttgtctaaggtttctctcacttcctcctcaccaaaagaagtttcacgcttcatgcaagtagccgcaaatgcctttttcaaaacatcaaagcttatctgatcagcctttgaattcataatctcatatacatcataaaaatccctcattctggtattcgcaagtcctcttgccaaaatcgtctgcatcttttccgcaagaagagtttcaagattatacgacaaaactgaaattgatctgtcttcaaacataagcttgtatttatactccactgcatctggcgtgattgcatcatccgtagaaatatcaatcttaaaaggttgtctcattcgttccagattagcttctatcatcatcctaatgccaggataatcaaattcttccatgatttcttttactgatgtaatcttaaagtttaccccatcttcaagctgaagctcaccgattctctcaatgatagctctagcatcattctcattaagaggtaatgctttcacagtggtatcgatatccattgtagccctcatgtctacaccaacaatagaagcaacaagcattccgcctttcaaaataaaattattcctgtattcggaaacagaaactctttctaagaacctttccataaaatatgttctaattagtgcttgcgcaacttcactattcccgccggacatgttttttactttgtctttaagttgtttcgctgtatgaatcataccattacctccacatacatcatcacttcatcccttactccaagtttaaccgcatactcaatcaatcttgatagattcttttccttcgaggacatatattccttgattgctgtctgatataactgaatttcatatttctttcgatctttaatcaaatcacaaatacatctttccttgtcatatactttaaccaaattaccgctgcttgacgggatttcacaggtccccatatcaagaatctctgggtttgcataatgaacttctttgtttttctttttgatatgtgtagcattatatccggtaggaacagtgaaacaaatatgactgtattctctgtcgataagaccatgcaaataaagggcggtctcgcccgaataaataatattcttatttcgttgctgaagtacaaacaactcatctggccacacattatctaagatataaatgccatgtgccactttttccatatcatgctctctgacgtattttgagacagatggctttgatacacctgattcaatggccttcgatgtaatcaaatatccattgtctttttcaattagcgattccaaaatatctgatgttgacatagttggcctccttatccttgatatttacttttgtgcttaaattttattatatttaagtgtaaaagtaaatataaatataatccttatatgcttgcagaagtaaaagataacataacttcaaatacctcgtttaatattccttctctatctctccatctattccatacattttcttgaatgcattaaggtctgcctggttcttaatcagcataacttcttctatcttacctgtatgaatgttcttaaagcctgcaacctgctcaccattacatatgctcgctttgattaccggtttcttattttctttatcatatacctttgtaactgtctttttcttaaatagtctcactctgaccaccttcttttgaatttgccatcattatcatcccagctgtagccctcgccacagccacatcttccctattttccatcatgtggaaagctttcatctccaccgtatccatcctatggcatatcagtacacttccaactattttaccagtcctcatcatcgtcatcaatagcatcatctacaccggcagcataatcatcatcgctgtcgtatctgtcatcatcatagtctccatccatatagacatcatcataaccatccttacctaacataattgcttcctccttaaattgtttacataaatactgtacctatatcgactgtgctaatccctgattcattaaatttatcaataactatacctattaaattttctaaatacttaggaatctcaaattttacaatgcgagaaattgccatataatgtaaataattcatccgtattgaaaaaataagatattcaattcttttatattcagcagtttctgtaatatctaataaaaattcatctattgtctgaagattgaacaatctctccaatcacatcacacccctatttctcacattttcaaaactctcaatcctgttgagagtttttcacctcttcctctgcaatatcatataactcagctagttttctctgcagaatactcttatcaatcaacttagttttatattcagcaatcattgtctgcgataaacttctactcaaagaatattcaacgacatccgtatcagcatttttacaaagaatcattcctacactcggattttcatgaggcttcttaatatctctatccaatgcctctaaataaaagtccatttttcccatatattcaggtttgaaatcatcaatttttagatcgatagcaactaaacactgtaactctctgtgataaaaaagaagatctacatagtaatcattatttcccacttggacatgatattcttcatcaatgaaaataaaatctcttccaaattcaagaagaaattttttcatatttttcaaaattgctttctttaagtcatattctttatatggttctggcaaatcaagaaactctaacatatacatatccctaagaacacctgtcatatctttactttcgattgcagatggggcttttccattagataaaagcaatctctcataatatccactatcaatctgtctcgccaattcttttgccttatatttttcctttgacgcaagttttagataaaattctttttcttcatagctttttgttttagagataatatgcagattattagaccatgtattttctctcaacagctttgagagttctggtttatccttgtaagtttcataaaactgtttcattctccaaatattttgtgatgaatatcctctaattccaggttctttactcaatatatattcagacaaagccttcacagtagacttgccccaaccatttacatcaatttgttttgaaacatactcaccaatagaccaatataaatcaataattgtagaattaacctgatactcagctttctgttttgccgaataaatcattccaagtacgttctcaaatactcccgtaatttcaatctcgctcataccttattctccttactttacctgccatacctttactcttttattatatctttttatacagttgatcaacttctgcttcgtatactgattcagtgtgagtatcaaacagcacccattccactaaatcaaaactgtccggattatcctgtaagaatctgtttactgtatgtactgcaatctttgctgccaactcaaccggaaaaccatatgctcccgttgatatggaaggaaatgcaatagaccttattccattatccattgccagcttcatggaattaaaatagcagttagcaagaagctcctcttctctattccttcctccattccatatcggtcctacagtatgaataacataatcacatggtaaattataggcttttgttatctttgcttctcctgtttcacatccatgaagtgtcctgcactccaccagaagttccggtcctgctgctctgtgaatagcaccatctacaccgcctccaccaagaagtgagttatttgctgcatttacaattgcctgcacatctctaatttttgtaatatcgccttttactgtccttatcatatcctaatcactctctattcccaaatttatcccatggtgtacgaatctctattagattgccggacggatcataaaatcttacaagcttctgtcctccgtcaagttctgtcagtgctgtagcatatctgacctcatacttctctgactccagctttttaactacaccttcgatatcattatcttcattacaccgctcaaactcaatacacttagcacctgtctcatcaactatattctatgccgtattatttatatggtcattttttcatgaataatgtaaacaataaaatatatatctactccatatccattctgcgtctcaaaaccctatatgctttgattgcgtgaaatataattacaatatctacaacagtatatacaaaacaccatacaaaactcattactgcaaatatactaaatatcagatcaacaattccaaatacagttataaacagcaaccgttccagacttattttgtttataagaacaataactgccaatgaaattactacatgaacaagtcctgaaactactcccattgctttatctatcgtgccatcaagttccccgaataaaataacagatattaatatagcaataatcattaggccaatacttatattgcgaatatctttaccataagagagaataatctcctctctttttttcctctgatacagaatttcattctttcttgcttctttttcttcttcacggattcttttttgttgttcctcctgctgagcttttaatcttccttgttcctgttgatatccaaattcaaagccaccagtaattttttgttcaacaacttctctatctatcaacattttatttccacaataattacatattattgcttcgagctcaggattaacttccatttgagctccacattttggacatgtcaaagtaattaatttcattttttcctctttttctctctgtaatgtcaattattatatcacaaatttaaagttatctctctgttatagagtgttccaattagttgggaaaaatggtacccttttatatacttcttcaatttgtacattcgaatcagacatttaatttttccctctatacaaaacaataagcacagttcgaactctaacgttcctatttttttcttactcttctattaaatttacacgtaggataattctcgcatcccataaatttaccaaaaggaccttgtattaatcgcaaacgtccaccacattcaggacatatattaggatcatatctttgcttttgtcttgctttttcctctgagacatttacttctgtatttatattcggatttcttgagcattcatagcacttccctttatttaattttccgaaaccaccatatgaagcaaatgcacttgccggagcaaattttccacagaactcgcacagtacccatctgcgtcctccttcatcaattaaaaccctatcttccggacaatcaccactatttatgacttttaggaattcctgtctcttctgtcttttttcaacctcaactctttcttgttccattcgggcttgttcttttttctcagcagcaattttttcctgctctattctttctttttctctacgctcaagttctgcctttctatctttttcagcttttattctagcctgttttcttcgttcctcgtcagctctcctggcttcttcagcatgtatcttatccaactcacgctgataaataattgcctgcttatgcttattaaactccagttgtttttcctttaacatatcagacagcgaatgattatgatacattatctgtgatgaatctgatatgtcaaatttacttaatttatctcttgctatattgactttttcccatactccatcagcatttttttcataatatacaactgtcaactcagcttttgaataatcagctccatctacatttaaaagcaggcaatagccctgcctcttctgaattttcattaacccttccgggtactgtccatttgtttcggatttatcccctaacgcaacataaataattgaattaccattgctatgctgttcaagaatagtaaatttatcatcagataaattacggtattcattgcaaaaagataaagctaccttctttttcgctgacagaaatgtaaattcatattttctttcagactcagatacagttcttataggaaccctgctttcaatatcatctgtatgcagtttatcctccagccaacattttagagcaatctttgaatcaattgaattaattccttcaacgggcatctgacatataccatcaaagccctcttttattctaaaatgctgttctcttaaatttcgttcacctgccaccagtacaagatttgctccacagccacaaggacagaacaactcattattacggctttttgctcgaagctgttcaagtttgtccggaatattaatttgtttaccatctatgacggtataaattgattcaattcctataaattttccatcacataatgccactgttctttgagccatatgatttcatccccctaactgcttcataagtttacattataattctccatcttcctgtgactgcctatatctcctctgataatagtccatagccctataatcaatcacatccttcatctgacaaaccatcaccggattatcaattagcggtctcagctcttctctaagcccgattgccgcaccatctttcttcacaaaaaatccctttcccgactccaaaaggaaatgcaccggcatcgatagaatcttctttaaatgttccttatccgatatggaattgtatttttgaatagtcatatttttatcgagatctttccagttggttccggttgaaaagaactccttccagcttgaaagcagctgctcttccgacacctccatcaggatatttccatgattataaaaagccataagcactggcattttatacacctttgacatgcttgtattttcaagcagactgataaattctcttcctattcctttgtaaaaaacctcttcatcctgattaagctcatccagttctttaagaaattcgagatatttcttaaatggattatcctttgaatgagcaatggctatttcataaattccatcgtccatatatgtgaacaaatccattctgtccgggcgccttccgagaaactccttcaccctgaaatattcattaattatatggtctttaagctttaaatgttttctgtccatttccgcaaaaagatcaattagcttcatatcaaaatctaccagacaatcatccggaaaagctgatgtatctgacggattatacacagctgcatgctgattactcctgtctgacagaagaaaacgcactctgcccgccttctcataattgccgataaaatcaagcacagtcagaaactcttttcctctgcatttacggagtcctcttccaagctgctggagaaaaactatcggagattccgtaggcctgaggaacattaccatatcaactgatgtgatatccacaccttcattgaacatatccactgaaaaaatcactctgattttgccctgcttaagctgcctaatagctacatttctatcctctgtgtattcgccgcttgcatcgctgaatactgctactgatggtattcccctttttgaaaattcttttgccatctcccttgcatgctcccttgaacagcagaagccaagcgcctgccttgagccgtatttacaataatatttgtaaatcagctcatatctgcgaacgttgcctatataggtttcatttaattccttttcgtcatatctgcctcttactatatgcagctttgaataatctgtttcatcaaagattccataataatgaaacggcacaagcattcctttgttgattgcttcctttagtgaaatctcatatggcacattgtaatcgcagatttcatagatattttttccgtccattctctccggagtcgcggtgagtcccaggagaaattttggcttaaaataatcaacaattctctgatactgttcattaacagcatggtgaaattcatcaatcacaacatatgtaaaataatccggtgcaaagtaattttcattcagatattccactctgccaaaagtcgcaactgacgcaaaaatcaccgacttttcagtgcatttactatctccgttaaagaatccgtaatcatctgaatcacgtacatttttaaatgattctgccgcctgctttaatatttcctcgcggtgtgcaacaaacaaaactctctcataattttttgaatcaaacgccgcaagatatgtttttcctacaccggttgcagcctgaaccagagctctccttgcgccctctgctctcgtattttcaagcgcacacaaagcctctatctgcgcgcctctcggctcaaatagcggtatctgatttgatgtctctttatcatcctgcaaatcgtatctatccaagtcctttgatactgccggacggtgccagttctttgaatattttttcagttcttcatcgtctattactatggaatgattttcgaataagtctacaaaagtattgtaaaacttctcataattaatcggatctgttttattgctgaatctgtaattccactcgataccggatgtcagtgcacttcttgaaatattagaggaaccaatgtatagctcactgtaatccttgtaatgaaacatatatgattttggatgaaatgaacggtttttctcattataaaagcgcaaatcgacctggtcaccaagcttatgctttatgagatacagtgctgatggctgcgtaatgccaagatagtttcctgtcagaatcctgatttttgcaccacgttttagtgcattatcaagctcaccgagcagcattttcacgcctgattccatcaggaatgaaacaataatatccacactgtcagccttttttatactgtctgcaagctgatagtacaggtacattctcttatccgcgcctccggtcattgcatctgtcgaatattttatttcatatacatcatctaattcttctgcagtattacgttcagccatttttcttctccccgccccggtcttacatcgcctgtaatccactcttccttcagttgcagattatctatttcaccaacaaactcttcaaatgtcttttccgtgaaatctgtgaaatagcggccatttctttctccttcaaagtcaccatacttaaaggatgtgtagattatgccgtcttcctttaatgctttaagcattttcataaacacggctttaagttcattcttaggaagatgaagtattgacgagcaggcccatatgccatcatattttttgttctcgtcaagttcttcaaatagcagccttctgacttgtattcctgtgtaattgcttgcgatatgacacatttcctctgaaccatctgtagcatctacataaaagccctggtccaaaaaatattttgtatctcttcctgaaccacagccaaaatccaatatatatccgtgctccggcaacagcgtgctaaagcgattttgtgtctcataaaaatccacatttattgttgtttttgcaaaattatctgcatttttgttgtaatattccaaggttttgtttttgttcatcatgagtttattataccattaagcattgaaaaaaactatattttaaaacctaactgatcttcatcatttactttgtcttcctctatcatcaccgtcttatccttaccatctctgattactttgcaaatgactccgccgtctgtcacaaacacaatctttccttttgccttaccaccgattttgtcatacagtctgcctgcactcattgactcacccttcacggtgtatgggctgttggctacgtagcccaccttgccaaatccttttatctttacctgtattgcttcgttgtcatactcattgtccggctccttgacaagcttgaccttcatgcctttttccatgaagtcacttccgtaataatggttgcatcctgctattgtaaaatacatttctttcattgtcgtgtcctcctgctattataccggtccgtcgattttacattcatcataatatttgcacagcatacataagctgttgcagtgttttgaatgatgcagtgtcctctttatccagtaaataaatttttccattttgtcctatcctcctgtttttcgtaaattaaatgcttgtttcttatgatggctatagcttagcattttacgagtcccaaagtctgccctcgcgcatcgaatctttgttctttattgcaataaaactacaaaaaaggacgcagattctctcccacgtcctcaaaactatctggttttcctccctgttggtgcaggagcaagatcataaatgacagaatctgctctggcatttccaatgagatcacaatgcgagtattgaaagtaccagtaaaaataatgtttctgccgtaggaacagaaaaagtttcaaaatatgctagaaaatatttatgaagtctaccaattaatgagttttcattgtataatgtctttgtcgtacagggtcactttcctttttaatgtttttgtgcaaattcattatacatcagaaagccctgtacaatttttttatgaaaaaagttgtaaattggtgttttataattaactcataaccacaagagaaggtgcttttaatggctatcataaaacaattcgacaaaagatctggtatgtgagtaacaaatcgaaagttaaaggagaactggcgatggatggaaaaagtcgggttttcagacctgaggctgaaaaagtttggcatgaagattatcaatgtgaatattacaggggagttatcatagatggtgaggacaatattgtggaacgttgcgctaaaatgcaccccaactatacagcagcttttagtgatgctgaagaaaaaatgtcagtcagtcctttatattcacggcagacaagccctgatatgaagaaaaaactggaagaatataaagcaaaaaaagcactagagaaaaaaaggaaaactaacgttatttttgatccgagagaacggaatgagtggaagtatatttatgattcctgcagaggaaatttatatcggtttaggtatttaaatcaggaagaaacatcttctgtattcctttcaagaaaagggcatcctatattaggtgaaatattatcgcggaatggcgaagctgattgggcattttacagtagcagaattaagaatgagtatgacattgaaaatctaccagggcataaggatatttggaagattttgtctgttgcaaatatttctaaaaataaaaatggggatagcgaagtgacaattaattatcttgagtttagtaacttgaccaaagattttaaaaaaagagaaaaaaccaaaacaattgtcattaagagaaaatgggatttctataatgaacttatggatttcttagtcgaaatgtaaagttgcatgggacgcattgttggagtactgtgtgaggaaagtaaatctatgtaaggtggtgtgtgtaatggattattatgatggactatcagaaaaggaaatacattatattgatgaatcaaggataatcggtagaacggaaggaaatagtaaaagattaagtgatttgatcacatagcctttaataataaattcttttaatactcgatttgcccaaatgcggaacatcgtagcctttttagaattaacacggtatccgacagcaataatagcatccagattgtaatagcttgtattgtaccgcttgccgtctgccgcagttgtttccattttggaaacaactgcttcttcctgcaattcgccggatgtaaaaatatttttcaaatgttttgaaatagccgccttttgcacttcaaataattctgccatctttgcctgcgtcagccacaagttttcctgatataaaaggatttcaacccgaacttcaccattatcggttttataaaacaggatttcccttgtttcataaggagttagcccatattcttcgttcatatccattcccttcctttcctattcttcacttttgtttctcgctctgcttttgtaaacattatgcttgttcttgcgctgccttcgctctcgattagcgtcctcatctcatcattggatctttatcaattgcttttcaagtgcagttgagaagcatacatcaatctagaatgagaagcacatgtaattaagactcattatttaccgtcctatcaatttttaattgcaggtgcaatatcataatccgtgaagcatgaatttgttgattgcagaaattactttaaccaattcattttataagcaagttctttaatcaaaaatgcattttcataatacatgtttatttttataattggtcgttttgaccttttatcaaacagtaaaatataagtaacgttatccccttgtttaatctccgcttcagatatgtcaacatatgcaatcaatttttttctctttaatatacttgactcttcaatatatccattaccaatagcatatttttttgaatagtggtaaccgcaattccagatgccaaatattaacaaaagtccaaatacaaggcttactactacattattatatgtaaatattcccaaaagcaaaaaagcaaaaaacactactaagcacaaaacacttagcaccctttgatattttgctggtctaataataaatctatctttttttcttgcattttttgttttaatactttgctcgctcatccataacataatgctatctgcgtactccggttcaaaagaaactttagtttcatcagaacatactataattaacgagccatttgagtttctttcaaaataataaatatcacttgcttttattactttttttgcacccaagtaatttctatatattatttgagttggctccaaatgaatataccagacgtcaaacattatgcttaaaatataccataataaacaaaaaataactataccaacatttaagtaaatctttgcatccccactaacatttgatggaatagtactcaaaaaagataataacactgtaaaaaacactgcaatcacgaaaagaaaataagaaatctttttcttagagaaataggttcttcccatctcatcctttttatattttacatttcctaacaatttaggaacgataatttttataagagtaaaaattattacatatgtgaatgctctaattccaatccatatatagtccacagatcaaacctcctatcaacatactaaaaacaagcatacatacaataaaaccaagcatgcaactaataatccctgatatccatagcgcaggatatatttttcgactttttcgtgtgataatagaaatcacgattccaataaacgagaataatggtcccaaaaatataacatcaatataggtatactgctgcattcacgattgcctgcaccttttttccgtaccctggaattaaagctttcttaacagctcgcttggcttttcctgttgttcttgcctttattgatttctttatactcggtgttctcattccaaacttcatcttaatcgcctccgttgtttcaaaaaacgctcctgctgccaagtacatgatcaaattcatcaagaacatccgtcatcagtcccttatcaatccgacttttacactctgcaatcagcacagccgggattccataaaatgcttcagaatttcaaattcatggtgcaatccatccgtccataccggacctactgtatgaataatatattttgcctttaggttatatgcaccagtgacagcaatatcacctcttgcaattttgccgatattcgctctttctgcgagaagcttttcctttcctgctgcctcatatattgctaagtccgtgccacttacacatatcggatttggattagcagtatttacgattgcatctgcttttacctttgttatatcgttgcgaacaatcttaaatggcattgtggcgcctccttatccatgcctgtattactttaacagcttccttatctgcttatccgttgcctccggatacatctcatgcatataatctacaatctgcttccatgaatcctgcggacaatccttataacaggaagtcacataatcgtatccatagatatgctcaatagatgaatacactgccacatcccatccatattcaatacctcttttattcactctcttcttaaaatcgcagttgcacagatatgtctgcatcataagattcgttattgcaccatcaaatcccttttctccatccttaccaaatccagcttgttttttcaattcatttgaataaatctctgaatcagcattatcttccataaaattgaccattatctttttatgcttattaggcgcttttccatcatcatataatgcatcaaaatcatatccatcccggcgataattagcaaatacaggaagccacttttttgatataaatcctgccttcttatcaaagaactttccatagacgatatcatgccgccttgctataatagcccgccacatccacggatcaatctccggattatcactccaccagtactctggaacagttctttcttcaagtgaaaacccatctatgtcattcttaaataatggtaaaaagccaaattcatttatatacttgattgcttcatctacagaatggatgcaatccgggttgtcccacttcatgccatgcataatccattcacctgattcgtttcccataatacaccctctatatgaacactattacagtaatactactcccaacagtaagcttataagcataatgatgtatccaattattaatgtcattatccaacatgtattgacaaaactcatattttatgttcctgcctctcgatttccttttgaatccatgtcataattacatctacaagataatcctgctgcacctgacttagttccttgcccggctgcattttatgccactttcggatgcactctctgcagcatgtagctgttgcatgctgagcgataaataccggatgacccttcattggtgtctgcttgccatcatttgctatatatgccggagcttctctctttgcaataaaatcctttgcatgttgtctgattgtgtccaaccctttttcatttatgtaatcaatatctttctgcttcagatggaaactgcttcggaacctggaattccccagccgctcaaataactgcctgtaccattcatccttagtcattaaaacttcaccactcgtttcatgaaaatcacctattattatctatcaataataggattataccaccatttacccctattcaacaaaccaataattttaatacaaaactgcacccacaatatccctgagtgcagttttgtatcaatcaatattctaatgtttctccatcaatgattagtcaacctaagtcaaggaaatccttggttttcctaactattctgttactccctgtcaaaataagaaaacctgttttcatctctgtaaagcacctttcggtgctcgtccggtgctcggagcacccggaggatgtaaccattccgttccatcgagttcactcggttggccaccattacgattcagctttgtaacaatgatcacttggctttcttattagattaactgtattataacgtgcagtaggtcggatgtcgatgattttttgatcatatttattgttttatatgttacttctctattagttctgcaaacttgaatttatataattattcctctaactttccctattttacaggctttcccgcctgttcattagtgaaatgatatgtagtttcccttatttttgcccttatgagataatcacaagggaaataagggaaattttttagtcattgcctaccactttatcaagaagccgaaccgattttcgtttcgcatctcttgtggagtgagcatagacgttcattgtggtactgacatctgagtgtcctaacaattcctgcacatcttttggggcagctccatttgctaaaaggttgcttgtataggtgtgacgtaactggtggaaatgaaagccttcaaatccctctaatgtttttgctacctttctgcataccgttcccaaagtagtcggaagttccagacagccatcaggtcttaagcagacgaaagaaatttctttataatctgccgggacttcctctgttctgtctaagcaataatactcgtagtacactctgtttttctctttgacctctttgtagtagttcgtgtgataaagttctccgtactgcattcgattctttaactgctctttccgggcattacggaaaatctctaccagcgtatctccaaaatcaacaatcctcacttttttccgcttggttggtccgatgatatatttgcgctttgagccatcatatcggatgctgcgtcttatggtaaggcattgttcttccagatttacgtcctgccacgccaaaccgcaggcttctccaatacgaagcccggcataataggctatctggattggaagtattgcggctgggttctttttttgaagatacgcaagcagtctttcataatcttttcgtgaaattggttggatatttccgtccatgtcctcatccgaaaacaaatcaacttcgtccgtctgataccgcagtttaatatactgcataggattgaacgtaatatactgttttggaaatactgcaaagcggaatgattgctgcatgactgcggaaaaagaatggatgtagtctttgctgtaaccctttttctcttttccatcgggatgaactcccccgaaggaaagcaaatcaaagaaggattgcaaatgctcagaggttacattttttaatttccgttctgccagcggatgtttcttaatatttcggattgttccgaggtaattctccaccgtaccattgctgagcgtacctgtttttaattcctcctctgcccacacatccagaagttgtccgactgtgagattttccgctttggcaacaaatttctttttctcataatcatccattgcctgacggagcagtttttcagtttcacttttgctttctgttccaacgcattctttctgaacaagattgccgcttgcgtcctctacatagaagcggtagtaccatttctttcctttttttcttacagatccttttgccataatcgtatgtctcctttcgatattagacaatcggaactgatgaaatgcttcgtgcgtgtaagtatatcataactccggttgtcttactataccgattcggaatcttcgtataagacttctgataaaagatttgcaagcctttgttctgctgtttttggtttcttggaatagagccttacaacgtctgccatctcattaaaagcattgatggtgtgagtgatttcccttaagaacataatctcattatattcatcattcgattcaaaccctattgttttggcaatatccgtctgaccagcattccccttgaagtttttgcaggcgaactggaaggaatccaaaaacagaccatattgttttaacatcagcagtaataaatcttttgaaaaagcatcttcttctttggtaagggcaagcggtaactgttccagaatatctcccatcgcatcacgaatctgtaactctctcttatccgtaatgtcggtttcatattcatctgtttcccctttgagccattccacagatacatggagtgcttccgaaagaccttccagcaccatttttttcgtattgtcaatcgaaccattctcataacgcaggattgtagaagcggtaacacccatcttttctgcgacataaggctgtgtcagattcaattccagacggcgctgttttactctgctgcctatcagcttgcgtagttctttatctttcatgctgactgcctcctttttcggtatgtatgaattatagcattgtttttctgtaattgcaatatgcaacttaaaaattatttttaatatttcgtaacgcttgacaaaaagatatgaaaaggatatacttacatcacaagaattgcataatgcaatttataaggaggtgattatatgacgcaaagaaaaattgcattatccatcgaagaagctgctgactatacgggaatcggcagaaacaccttaagacagcttgtagaatggaagaaacttccagtattaaaggttggtcgcaaagtcctgattaaaaccgatattctggaaatgtttatggaagcgaatgaaggtcgtgatttgagggatagaggaaatgtaaaagccgtaacaagaactgcggcaaattaaaaaggcggcttccaaagaaaccgccaaaggttctatcagaccgaagccatgatatacctacacgcaagaagattataccatgtgcttcttctgatacgcaaccgagaacttatgtttgtaaaagaaaggggaatgtaatcatggcaaaatcaacaaaaagttatgaagaacgaatgcttgaaatggaaaagaaggaacaggaaagccttgaaaaagcaaaacgatatgcagcacagaagaaagaacttctgaaacgaaagaaagccgaagaaagtaaaaaacgaacccataggctctgtcaggttggcggtgcggtggaatccgttctcggtgcgcctatcgaggaagaggacatcccaaagctgattggttttctgaaaaagcaggaagccaatgggaaatttttttcaaaggcaatgcagaaagaaacacataccgatatggaggaagtgtaatggcggggggggatgagtttttcattcccttcattgctttttcatgaagggcgcacttatggacaaccagaggtcgtcccaataagtttgccacaagtggcaaccggtcttcgctcacgcttgccgggctcgttccgtcggcggggctttcagccagacctgctcatgccgcaggaggcactcttcgccagaggggcgcattccatgcaggctgctatgcgcagggcactcttacgcagagggcgttccggcaatactgctttttctaaaactgaaagcaatgttgccggaaatctatgccggatgtgcagaaagggggaatccagacatggcgatttttcattacacaatcaaaatagtcggacgaagtaaagggaaatctgttatctccgcttccgcatatctcaatggggatgtgatgaaaaacgaggaaaccgggcgaatcagttattacacttctaaaaaagaagtggtctacaccagtctgatgatgtgcgaaaacgcacctcctgaatggcagatagtaccagaagaaaatataaaacgctttcaaaaatctgtccgatacaaaaggtcagaagataaagaagctgctttagaaaaatttaaaatcacatttcagaaacaacggttatggaatgaggtattgaagattgaaaaaagtgcagatgcccaacttggcaggtcatttgaatttgccctccccaaagaatggagcagacaggaacagattcaatatacagccgactatatcaaaaaaacatttgtggataagggaatgtgtgctgattggagtatccacgacaaaggggatggcaatcctcatgtccatctgcttctgacaatgcgcccttttaaccctgatcattcttgggggaagaaagaagtcaaagattgggattttgtcagagataaaagcggaaatatcgtgattgatgaatcccatccgaactggtggcaggataagaaaaaccctgaccgtcatggaatccgtatccctgtattagatgaaaacggaatccagaagattggtgcaagaaaccgcctgcaatggaaacgggtactgaccgatgctacgggatggaacaatccaaaaaactgtgaactgtggcggagcgagtgggcaaaggtgtgtaatgaacatctgcctttgcataatcaggtcgatcaccgttcttacgaaaagcagggaaaactccagattcctaccatccatgaaggtgctgacgcaagaaagattgaacaaaagtttcttgccgggcaggaaataaaaggttcgtggaaagtagcggaaaatcaaatcataaaacaacaaaacacgttattgcaaaagatactggacacctttgggaaagtatcaggtgcattatcattatggaaggagcgattaaatgacattagaagaaagccgggaaattatacccttaatggagtccatgattgggcaaatcgaagaacagcagaccttaatggcagaaatgcttctggaaatgcagaaccgggacacccaactctctcttatgcaggaacagaatcagaaattgcaaaaattaaacagcgagttatccgagctgctcaacattttgccaaataccgaggaactgctttccaagatggaagaacagaaaacgaagatagaacttttggaaaacgaaaatcagcaatggcagaaattggtacagaagctgaacagcgaaaacagtttattactgaaacagaacaccgaattgctgaactggaacagcagatagagaaaggacgtgatatagatgaacgaatccagagaatcaaagaacgccgaacagttggaagaacttctcctcttgaccgaggagatacaagaagaactggaacagaaagaccagcttatcgtggaactaaagacgcagctcaacgaatctctgaccttgaacgagaaattaaacaaagagaacagagccgggaatattcaagcattaaagaacgacttgaagctagcagacagagcattgcggaacgagaaagagaagctgcgaagcgcaaacgtcacgataggggaatgtcaagataaaatacgatgcttaacacaacaacgggattatgcccggacacatcagaaaatcgtagagataccggtagaaaagccggtaccctatgaaaaatgtgaagcctgtgaccggacagcctatcagaatgaaaaagcgaaatacgaaacacaaaaagagcgacttgcaggacagtataaagcaaaaacggtaatgttccaaacaaccttgttccttcttgcatggtattcgctgacaaccactctttttcaggcagtacagtcagatgtgtttctttccgattgcaaatcattcttccatgatgcagcgtcattcatacaaacttttatcggttggacgattgaggtcgggcaatctgtggcacagattagcacaaaaattccaaatccttttatagccggaatggtatattggatattgctaatattgattgtaggaatatgtgtggcaggaacagggatactggcgatactgatagaaataaaggttatagaattatatagggaaaagtgttgggatgtcattactctactgatgatactgacaagtgctgctgtcatcatttattttggagaagcaatcaaaaaagcactgtcagtaaatcttctattgctttttgtacttttgcagggcgcatatgttggacttaggtgttatttagaatcgtaccttgagaaaagaaactattaagcattttttacaaagctatgtacaaaatcattctagaattcccattcaataatacgattgagaaaacctctctgatacagtataataaagtgttagggaggtatctctatgaaggaaaaaatactaatcattgaagatgattttacgatacaaacacagcttaaaactcttttgtatgggaatggatatgaagtatttgcagttacggatttttcccaaacaatagagcagttaaaagaagctgcaccacatctggttattctggatataaaacttccggggaataacggttttgaaatatgttctcaaattcgcactttttcagatattccgattgtatttgtaacaagcagcaatacagatatggacgaactaaacagcattatgctgggtggagatgcgtttatcacaaagccttataatcctgctattcttcttgctaaaattgctgcattgttaaagaaagcctaccgttcctctcaaacagaaatttatatgtggaaagaagctaccctgcatttggagagtagcatgatagagtacaaaggacagaaagcagaattgacaaagaatgaattgaaaatcctctactacctttttaagaacgctggaaaaatctgttccagaaatgatattgtggattttctttgggataatcagctttatgttgatgataatgccctaagtgtcaatattacccgtattcgtgacaaactggcaacaatcggacttgtagatttcattaaaacaaaacacaggcaaggatatacattatgaatggaaaacaatatttgaaaaatcaactccccgttattttaatcaatctgctgggtatgcttgcctttgccttgttcctgattgcaagcgataatcctatccaaacagtcctgtttattcttgcggtctggtcgattgtccttgttttatctttgctgactttttatttctcacgaaaaaagtatctgaataaattgctcaatatgacggagcaattagaagaacgatatttattgccggaaatcatgcaagtgccggaaagggctgatgaacaggttttttaccagattatgaaaatggctgaaaaatccatgttggaacggattggcgaagtacagagggaacgcagggaatataaagaatacattgaacaatggatacacgaagtaaaaacaccaattacagctatgaagctgctgtgtgagaataaccgttctcccttttccagagaggtattggcagagttagagaatatcaatcaatatacagaacaggcactttactatgccagaagtgaacacgctgaaaaagactattctgtccgtgaagtcaatttatgcgatgttgtgaatagtgcaatcgcagataataagtatcttttgcgtcaaagtaatatgtcaattcagatagacgatatagaaacaatggtttacactgatgaaaaatgggtgcggttcatcttaaatcagattatcggtaatgcaatcaaataccatgcagagcagcctattttgcactttggggcaacaaaaacgaatgacaagattgtgctatctatcagcgataatgggataggtattcctaaaagtgatttaccccgtatttttgaaaaaggatttacaggtcagaatgggcgaaccgggaaaaattctactggaattggcttatatctttgcaagcgtctatgtgataaactgggaataggacttactgcttattccgaaaacagaggaacaacgatttcacttatctttcaaatgaatgattttattatcggagtgcagggctgacaggttctgcacttcttacatttttgtaagaactgtgtaagaaaacttgatacaaaaaatgagatactccatttacaatatgggtatggaacagttaaggaggtttatccgatgaatacaattttgaagctggagcatatccagaaatattatggcaatgaggggaatattaccaaagccattaaagatattagtttttctgtggaagccggagaatttctcggaattatgggtgcgtccggttctggaaagacaacgctgctaaactgtatttctacgattgataccgtaagtgcagggcatatttttttagagggaacagatataacggaaatcaaaccaaaattccttgcccgctttcgcagagagaatttaggttttgtatttcaagacttcaatttgctggatacattgacaatttcagaaaacattgcactggcattagcaatcaataaagtccctgcagggattgtagaaccccgcattttggatatagccggaaagctgaatatcagcgatattctaaacaaatatccttatcaggtatcgggcggtcaaaaacagcgttgtgcctgtgcaagagcaattatcaacaatccgaaactcttattggcagatgaaccgacaggagcattagacagccattcctcacaaatgctgctgtctaccattcaaagtatcaatgaacagcttagggcgacaattcttatggtaactcatgacgcttttaccgccagctatgccaaccgtattctttttttgaaagacggagaaatctttatggaactgcgcaagggcaacgacagcagaagtgctttttttgataaaattctgaatgtccttaccatgattggagggggacagagccatgtatgctaaacttgttttcagaaatgcaaaacggtctgtaaaagactatctggtctacattgtcacaatgacaatctgtgttaccttgttttatgcgttcttgtctatttccagtagttattatagcccggatataggcagcgagtatgattttactctgttaagtgacggaatgaaaattgcaatctgcatgataacattgctgttgttatttttgatacggttcgtcaatcattatatgctaagacggaagcaaaaagagtttgctgtccagtccattatgggaatggaacaaaaaactattggcaggattttctttgcagaaacactgattatgggtatgttttccattttgattggtattttttgcggtgtattttgttctcaattcattaccgcaatgctccttactgcttatggaaagccttatgaaatctcatggacattattcccggataccgttttgttgacagtggtattttttgtggcaagtttttttgtggtaggaattttcaatacccgtaccattcagaaaacaaaaattattgatatgctttccgcagagaaagagaacgaaccagagctaaaaaagagccgcttcatttctgttgtagtagtcctctttgaagtatttaccgtatggggattgattgcaggaatacaaaaggtctggttttattatgacacccgctttgcgtttccggtgcagcttatgttttggggaaatattctttttccgctgcttactttgctgtggtcgatattttgcataatcagaaagaaaaaaagagaatgtttcattgctggtttgctgatatgttctgtattgaatgcttttacagcagccagcgttgcagcattaacaaataaatattatctgcctttaggtggtggaacgctcaatcaatatctgctttttgttgtgattgacttacttttcttcatttgtgccttcatttatcttaccagtggtttgattgtagcatggaaagaaaaatcgccagaacaccgataccatgaggaagcacttttctttttcggacagattacctcaaagctgaatacgaccagcaagactatggcagtcatttgtatcactttggtattagcaattttcatgttcgttgcagcccctattttgacgggctggtcgtctggttatttggatatacgctctatgtatgatgtgcaggtatattcgagatacaatgatgtttatgaagaagaaaatctgccacaggacagttatgaaatcattactgattttctggcagaacataaaatagatacagactatgattgcactttcaatctatatctgccagagaaagacgattttcacaacagacagaaatatgattttccgattgtggcaatttctttaagtgattataacaccataaggaaaatgttgggttatgaacagatttctctgggggaagatgaatttacgacacaatgggcggcaatcgccaccgaggaagaacgggatagctttttgaaagagcataccagtattttgacagacgcaggagaattgactctttccgagcagtcctattatgaggaagcaatcggagaaacagcgtacaattcctatacagatatactctatgtatttccagacagtatttgtgaaaagctgttgccggtaataaaaaaccgctatatcacaacagaagaaaacatctcctatgaaaatgcaagggaactggaaaaattttttacagaggaatacccagagcaagcagaaagcggtgttatgtatggaatacggttcagtacattacagaggaacagtacaatagcaaataattttgttttacaggctgcaatgctttatggtgctgttgtattgatgattatatgtcttaccgtactttccttgcaacaactcttagacgcaggacaatataaatatcgcttctctgtactccgaaaattgggggtggaagaaaagcatatcggaaaacttatcttgcaacaattaagtgtttggtttgggcttccaattatcacagcaatcattgtagctgctgttgtaatagcttactttatccaaaccatatcagcagaaatttcagcctatatcgggtttggtgcattgatgttacaaataggggcaacaatgggcattttggcaattttattgatttgttatttcataagtacatggattatttttaggcattctgttaatccatagaaaatatgtaattattgcatttcgcacattctttaaagagggatagcactcttaatgaacactatccctctttcacttaataaaattctaatgaatcttctgcatccacccacatctgtaaattgccctcaagatataatcttgcatattccaaaggctcatccacagctaatgaagtaagtgcacattctgatccatatgtggtttttaaatctttttcagcttcccagcagtcaatgcgaagcatatatccagcacttgtgtaaacatcaatactatcgtgatttatgttgtattctgcataaattgttctcatcgtatcttatctccattttcttttgataatcagtaatagagttaaatatcgaaaacatttcaatcagttcaccatgtcgttattgttatatgttatactgtgttatgaaattttctttcccttaatttttcccatattaaggttcatgaaagctaatgggagaatgtaacacaagggaaagagtaagggaaagtacacttgctacaaacttagtattttcaagggtttgcgaagaatttgataatcaaatataacagttattaaatttcctaaaatatgtgaaatatcaacttgaagttatcgctttacttttgttgtatcttagccaaaatactttctattacaagtgttactgttataaaggttcctacaagggtatagtagtttaagccatacatcaatggcaaaagagaaataactgccgtaataatggaaaggacaaacaatgctttgagaacacctttcttcttcaatgaaaacaatgaaagtaagaagatggcaacagtaagtgtggctgtaataagtggagcaaaatttgcatagccaaacggtgtaaggctaaagtatgagaatgtttcttttactctttctgttggagatgttgcaaatatacaaactgctcccaagggtaataattctaacactattgttaaagctggcaaaaccgctaagcagactttcttcatgttgtatatctcctttacaaattccgattgaacaaaatcgctgcgcgatggcctgccaaggctgtggcgcagttttatttttattaaaaagcagtggaattacttttcataatccgttattgttaagttaccacacgaaacaactgaactaagaaagctccactgcctatgataagaataacattttccagtctcttccgcaatcggaattatgacgctaatgcacctccgaataggtagatgtaattattaacactacttattctggaggttttattatgtataaagatatttttgaatctatccgcaatgaagcggaaaaacgtaacctgcgtgaaagaactattcaactgtattgctctgatgtcagttacttccttcgttggattggaaaaaacgtttctgatcttacgcttgaagatgcggaaagttttcttacagccaaacgtctggaaggaaggtctcctgaaactcacaatcactatcggtctgcaataaagttcttatataaaaaggtgctgaagactgtctgggatgatgacactgttccagctatgaaaagagagcgcaatcttcctgctgttctgtcccgcgatgaaataaatgcaatcattgatgccactccgaatctgaaacataaagcgattattgcaactatgtattcttctggattacgtgtatcggaggtcgttcatctccattatgatgacatttcccgtaccaacatgacaattcatgttcgtgaaaccaaaggcagaattgacaggtatacgattctgtctcaaaaaaatttagaccttctcactgagtattggtacaaatgtggtcgccctaaagatatcctttttccaagttcctggaccggtggatatcttgatataaccggtgttaaccagttctttaagaaaagtgctaaactcgccggcattacccgtcatgtttcctctcatgcgtgccgtcatagttttgccagccacttattcgaaagtggcacagatataaaatatatccagtcacttctgggacatgttgatcctcgctctacagatgtttaccttcatgtgagcaacaagacacttcttggtatccgcagcccgttcgacaacccggaaggtggtgaatcatgagtaaggattgtacgattcaggatgtttttcatcgtttttattcatcttttgaatccacacatagtatttctcccgctcagcgaaaggccgcttatcacatcatgaattgcaaaactggtgcctttggtgtgaatgtaagtgtatgcgaggactgcggctgcatatcagtccactataactcctgccgtgacaggtgctgtcctatgtgtcaggagtttccaaaggaaaagtgggtagatgcacggcgtgaggatatcttagatgctccttatttccatgtggtttttacagttccggaagaactcaatcccattatctacagcaaccagaaattcttatacgctgctctttatcatgcggcttcagatactctcagtgaacttgctgctgacagtaaatatcttgggactgatatcggctatatttgtatccttcatacatggggaagcaccatgaattttcatcctcatatccatgcgattgttcttggtggagggctggatgtgaaaaatcattggaaagacaacgggaaagagtttttccttccgattaaggtgatctccaaaatatttcgtggaaaatacatggctgaacttaagcagctctgggaaaatgacaggcttgaatttcatggatcggctgcaccttacaaaaactactatactttcaaggaattgttaaatacctgctatgcaaaggaatggattccttattgcaagaaaccatttgacggtgccgaatctgtcatcagataccttggaaaatacacccaccggattgctatcagcaactaccgtatcaaagacatgacagaatctacagttacattttctgctaaagattacaaaaaccaagggctttggaaagagattaccatatccggcgaggaatttatccgtcgatttttaatgcatgttcctccaaaacgttttgtacgtatcaggcactatggtcttctttcatccagaaataagaagaaaaagattaccctatgcagaaacatccttggttgcaaaaaatatatttccaagctgaaagatatggatgcacctgccattatccgtcttctttataataaagatatatgcaagtgctcttcctgtggtggtaagattattcctctgcctacagaacaacattttataaaaccaaaaccacatatgctctgttaacgtatcataactgtatatttttttagcttccttagggaggcttatttctggtgtcataatacaggactgaattataaattctatgtgtttctatgtgtacatgctatcctattataaatagagtgtcagaattaaaagtccatatagagttgacgcgctttgttcaaccagaaaaaatcgaaattgatgcaaacgaaagggcagttaatgaaaagtctcaatactgctttttcgtttgcaccaccttcgattcttttcttaacgattttgatgtctgtattataccataatgatactattatgaaaaaggaaaaagagttctttatcatttgtctttgcacatctattaataatcgttttgttggttacaccacgcattttgcttacttcaattggtgtaaactcatataatcgcttttttaacagaaaggctaagaattccttttcttttgcatttaagtaggacaggcttccatctaactcatcgttctcggattcttttgataattcgtatacttttttagaatacaataacattaccacgatctttttaaatgaatcagggatatttctaaatgaattaaattcctgcttctgcttttcctcagaggtcatatcataagccacctgaatataatatctctgactaccctgattgactacaaaatcaacttcaaactgctttcgagttgtttttccttcatcatttttcgcatacatctctacaataccaacatccacattatatcctctgataagcagctcattgtaaacaatattttctacctttaatatcatatctggcagcgggaatgaatgctcaccttgcaaagcctgtaaaaatcgaaaatgtaaagaaaattttgtgcgattattcggtatagcgattaggatttctcgaatccgtaaacccattttccacgtaagaacagatacagaaaaatcacggagctgataccccaagtcaatgggtatgcccagaaaatcactcgtatatccgggataatacgaactgccacagtaatgtagcttacgcgaaacagacaccagtcacagagcataacgatcatcggaacggatgcgttacctgatccacgaagtattgctgcgatgcaatgagaaaacgccagcagacaataaaataacgcaattgttctggactgcatgactccataatgtacaacatcaggatctctgttaaacgctgtgatcagtaccggtgctgccacatatatgataataccgatcaactctgcaatagtaatcgagcagaaaactccaaatcttgctccctttttcgcccggtcatactgttttgcacccagattctgactgacaaaggttgtcagagccattgtaaaacaggtcaccggcaaaaaggcgaatccctctatcttggagtaggaaccacatcctgccatcgccatttttccaaatgcatttatatttgactgtacaaagacgttcgcgatcgcgatcactgaattctgaaaaccggatggtacaccattctggatgatctgcttcagcatagaactgtcaaaacgaatctctcgcaattccagacggtattcttcttccacacgcagcagatgaaccatacagagcagtgcactgacaaactgtgaaattgcggttgcaagtgctgctgatccgactcccatgccaagacctgcgataaagaaaatatccagaacgacattgacacaggaagaaataatcagatatatcagtggatggcgtccatcaccgaccgactgcagaactccaacaaagatattgtacatgacaacacccatagaccctgcaaaatatgtacggaaatacacaatagattccgggagcacgtccgcaggagttcccatcaataccaggatctttggtgccagaagcattcccaaaactgtcagcacagcaccggccacaagtccaaatgcaaccgttgtatggattgccttttgcaggcagtctctttttttggctccgtaatatcgtgcaataacaacacctgcacccatggcaatgccgttaataaaacctaccatcagaaaaatcagatttccagatgaactgactgccgccagtgcattacttcctagaaaatttcctacgatcagggaatcagcagtattatacaattgctggaacagatttcccagaaacaatggaattgcaaaaaaaatgatcttttgggagatacttccctctgtcattctcagactctttttcatagttaaaattactcttccctttcctgtgttctttgaatcaatagagatgaaggactgctcttcgtgatagttgcctctctaccttattatttgtaccataccatgcatatgttgctgatgtcaatgtaaagactgcttgtagagctggaatttggaacgtgctttataaattttttccgatcccctcaagttcgttcattgaatccttgtttttttcaagttcatctctggctgttgcgtaatatgattttttgaaaagcatatcccatgaaagatattttgccatacagtcaaactgcttatcaatcagctcatactggatactgtctacaggagaaccgcctacaacaatcgtgccaacttttttattttttaactgcaatccacggcagtagcacttatcaatgataagtttcaattgtgctgacatcccccaccaataaactggtgtagcaaaaagaatcatatctgcggcagcaattttatcaattgtaggatttgtatcatccttatcgacgcatcccttagagcattgacagacaccacatcccttgcatggtgcaatattgagtttgtcaggttcaatgatttcaatttcattcttttctgatgctccttttataaatgcattgattgctgtcagcgtgtttccttttctggcacttccattaatgattacaattttcatgcgtgtatcctccatcttccgatttgtatgtctctattataccatcatgatatcatcatgaaaaataaaaatagttcataaaatacatattttacgaactgtttgtatttttgatcagttttgcaaactggaaattatcttcctgtcaatgactttccaacaacataaactccaactagcatttctgcaattgacaatcccaataataatccagaaagaaagtccttaaaatcagaaccgcccaaggtatacgataacgcctgaaaagcaattcccataacgataagaataagaccagttaacattactttttgcttttctaattcttgtgttcttcgcaacaaatcaagcatttgttcatcatcgtatatgcgaacacttttatcttcggctttttcgccgtccaacaattctgccactgtaacctcaagttcttcgcataaactcttcacaatagaataatctggcatacacttgccctcttgtgtcaagcagttgacaacatttttcttaaacttttttcttcctcttcattataccagcttccggctaaattaccaccgaaagctgatacatctccttagttgcttctgttgctaaacttccacctaagctctatggtcttgtcggcatacacgactaccttatcaagcagtacatccagaagctcgtctgtaatctctgcgatttcagacttaccttccagaaactgtattccactgttctcagacggcatctggttttccagtgtaaaaatagcttccttctgtgcctctatcttctccctgattccatctatcatggcttcataggactgcttctgcataagatatgtttccctgtctgtaacaccctttgcataggattcgtatgctgtccgaagctccagttccagtctccggtgtgtatcttctgccatagccagtctctgctttgccccacggatacgctcattatgttgctctctttccttttccataagaagcttcagctttgcaagtcctgatatctgcttggaaagctcaccttttatgataccatcaaggtctgttacaagtacccggtggacacagttattattcttcctgtagttcacttcacagttgaaaaatctcttgcccaggcggtccttatggtagatcatatttctgccgcaacagttgcagactaaccttccggtatagaccgatgcctttttccctaccggtgtaaaagcctccggcacagttcccttcatcgcttgtaccttctcatatacttcctttgaaactatagcttcgtgatggtttggtatccgcttccattcacttggcggaagcatcttcttacgtcgggaaccaatctctttcacacggctttttccatacacaaaagtaccgatatacatctcgttattcaggatggaatttaccttataatctgtccacaggggcgaatcccctttggtgtacatatttgcgtatgtaccctttcttctgtggtacgccgcaggagtatcaattccttctccgtttaatgtccttacaataccggcaatactcgctccacctgcacgaagcgtaaaaatgctcttcacaacagcggctgcttcctcatccaccagaagctcacaggcattattcttggattttaaatatccaaagggagcacatatcccgataaacattcccttatccttccttgccattactgccgtagataccttctgcgaaagatccttactgtaaaaatcatacagcagagccttaaactgcacatctatctcaccgataccgcccacataatccttactgtcgtaattatcgttaatagctataaaacggattcccataaaaggaaatatctgttcaatatacttccctgtttccagatagtttcgtgcaaaacgggacatatcctttacaatgatacagtccaccctctgctcttttaccatagcaagaagctcctgcattcccggacggttcatgtttgtgccggaatatccgtcatcacacttttccgttacagtcatggaacgcaaatcttcatgtgagcttatataatcacggatgattctacgctgattggtaatactgttactctcatccgcattcacatcatcctccaaagataatcttaaatacataaccagattagacatctgtcctacctccttcattccacttggttcttctcggaaaacggaatgtatccgtataaccagtggacttatcactgttaaaacggtactgaatctccatatgccggtccgctgtcagggtaatccctgaaataagggtttccacaagctccggtgtcagaaccgacttatcctttacggatacaagggcatttacaaatttcttctgctcctttgtattacgaacaaaagctttgtaatccttctcagcttgtaacagctccttatcaagccttaccctttcctgctcctgccttctattggcatcttcaagctcatccctgctaatctcaccctttacatagctcccgtaaagttcacttccttcaaaggaaagacgctccgcacgcttcttcaaatccgctatccttgccttaagcgttgtttctgccggctggaagcctttttccaaagcattcagaagcttctttttatccggcacaagctcctttactgccttttgcaaagattcaaacaccagcaaatccagctgttcctcggatatctttattacagcttccttatccctttcctccacaggcagaggattgtgtctgcaacggtaataatacagtcgcacatccccttccccggaataaataatggaagattctctcgaaaaatcaccaccacacacgggacattttaagatgcccttatacctgtctgccgtcagcggtaaatcttctcttgccacaaaagatttcttttcctttttcttatccactacacttcggacttcataaaaaagttctttagaaacaatagcgtcatgggcatcctcatggataatccactcattctttgacaccttttgtctctccaagccctgatacagacacctttttgtctttccctgctgaagcgttcctatataggcttcattggaaagaatctgggaaatggtaccattcttccattcactaagaggctccccttccgtgatataggcaagttgcgtctgcctatattcttccggtattctgacccctgcctgtgtcagctcccttgcaatggcacggtggctcataccgctctttgccatctgaaatatctttctgacaatctcagccgcaggctcatctataacaagtctgtgtccatcatccgttttcacgctactgtagccataaggtgcatgaccaagcacactgcctctttccatacagctttgaaatgccgaagtaatacgctttgacacatcctttgcatacatatcatttacaaggttcataagagaaatcccaagccccttgtttccgttgtaatcctccacggtatcaaaatgatcgtttactgaaataaaccgcacacccagaaatggcagtatggtttcaatataattacctgtttccagataatcacgtccaaaacgggacaaatcctttacaataatgcagtctatctttcctgccctcacatcatccatcattcgcataaaatcaggtctggtaaaagtggttcccgacacacccctgtcaaaatacttctgataatgggttagttccggtcgctccttgataaagttttccataatcataaactgactttctatggaatcacttttcctgccatccttttctaccgacaatctggcatacagcgcaacatgatactgcttctctgttgtaacatatgttacagttttatccttatcagacgaaggaaccttatccgcaagtgcattaaatcttccttcttttcttgccatcctaggacacctccctcatggcttccgcttccagttcaccctttacaagctctaccgcctttgccatctcattacggtacttaaacactatctctaccgtcttgtcctcatagactaagatcttgtcaatcagagaaaccaaaagcatacggtccagcttttctatctccatattttcacgcaagtcatccagccactgtcctgctgcaattccgttttcgtatatggattttacagttgtctcctgcaccttaattgcagctgcaatctccgaaagcttgttgctgtaaatctccctgtagcggttaaactgttcctgtgtaataagcttctcctgtaaatccgtataaagggcagatttcatggcactgtattcctgctccttttcctttaacatcgcaatctccttatcacggtttagggcttcctcaaaacgaatctgctttgcatctaagatgcttaacaacttcttggtatccgtaagctgcttcacatactttctgacctcacccaaaacaatctcatttaatacatccaccttgatactgtgtctggtacattccttccccctgttatagccggagcagatatagtattcgttcaccgtatccttataaggaaccttcctgctgaccagtccccttccacagtcaccgcagaaaagaagcccggcataaagctttggctctgtcattctttcctttgctcttgtatcacgcttcaaaagctcctgcaccgccttaaaatccgcttccgtaataatcggtgtgtgattgttctccacccgaatccactgggactttggcttttctatggtctttttcaccttatagcttaccttttctcgcttcccctgttccaaaacaccgatataaatctcgttagaaaggatgcgtaaaactgcctttggtgtccacttcgcctccggattcctttgaaagctggtcttaaacttttccccgtgagcctttttatactctgccggcgaaagagttcctctttcattcagctttgccgcaatggaattggcactaagccccatcagcttccatgcaaaaatatcctgcacaacccttgccgcttcctcgtcaggaacaatcttatttttgtccttctcatccttacggtacccgtagcagacaaaagaaccgatatactctccattcattctttttacctgctggttactgcgggactttatggaaatatccctgcaatagctctcattaacgaaattcttgacgggtacaaccatataccggtcactgctgttagcggtaagactgtcataattgtcattgatagcaataaacctaacattcttctgtggaaaatacttctggatataattgcctgcaccgatatactcacgtccaagtctggataaatccttgacgataatgcagtcaatctctcctttctccaccatggctatcatctccataaaagccggtctttcatagtccgttcccgaaaatccgtcgtcacagacctccttaaccagctctacatccggaaacccccgcacaaagctttctatcatcatacgctggcttttgatactgttactctcatccgtactgccacgcttatcatcatcttcccttgaaagacgaaggtaggcacaagcacggtatttcatctcactcataatgttctcctttcccggtggcagaatctgccaccgtctgtaaattctctagtatttcagtgaagcgactcgatcaatataggctgacaacaaatccgtgatactctccccggtatctgaaaatgtgctgattaccttgtattccccatactttgtggtatgaatatccccggcaagctcacaacctatagtttcctctatctcttcactgacagctttttgttctatcagttcgtccattctacttcctccagttttcacattagattcatggaaatgcacctcaattccgcttcgcttcatctcagtcgttgcatttcctcattgttagcacgcaaaaagaccgcctccatggcatcagagtctccctgcatacgcagtccaaacagatacatgttatctgcttcttttactctgtctgccatgaaaagcggtcacttaatctaatgtgcatctcaactggaattattgcactctctattgcttcttcattcaaacatattcagttaatacggttgcaagtacgacacttcgctggctgggctccctgtcggtaccggtaatccggtattatcagttacggtaatcttttttagtggaaaatataaccactgcaacctgtgagtcagagtatacatcaaaatctcccgactggcaagtgaacattaaataaaatttgctcgaacctgttccttccgtcagtttaggcgatagcgcaccttcccggttcgcctggctgtgccttgattctatgatgttaccttccttactgaatagtaactgtccaacgccaatccttaaaatactttgtattgcttggtcttaaacagttacaagtaaaagctttgattcctcatgttccgtaaggtaaaaggcaaagtttccctagggacttgttttgcatcttaccttacgaaacatttgtgaaaaaggaagtttgctgttctcaccttatgaagaatgttaccgtttcaggtaaccttgcagccactgtttcttttttatcatccacagcctgcatgggtctcttctgctcaagatcctctcccaccctttgcggaagtgtcattatatcttcgctcgtccgttaccggagtcatggcgtaagtctgttgttcttcataagcagctattcagttgtttaacgataatccctgcttcgattatctgttttcgttttttgattatagttgacattttctgcaaaatcaactattattcttataaatcgtattgataatcgctattttatgtttaacactttagcgattttcgctatagttacgatactatgtttaacaaagaaaggctgatattatgggcatttatgagaattttgaatccatcaaggatatgttaggatatagaaaatttactacggaagagattatagagaagggttatttgtcagaatccagcattgcacagatcgataaaaaaatggatgaagcacactctgtgctgtgccacttccctattggatatacctataatgaaaataaaacatccttctaccggattgctctgagcgagcagttccagatattaaaggaataccctgctggtacaagtattcttgattttattgcattggaaacagaggaaatcattgcttatatgaaaaatatgtccgaaaacattactaccatgattgaacaaaaggcttccgcaccggatgcagatggtattatccgctttaatttcacggatgttacacaaaccgctgtaaactccacactggcagcactccaaaaggacaacttctttctgttccttgttaactgctgttttctccagtatgtaacggaactgtttgtatataacttttatccgttcattgcactggagcattataaaaaaatcttagggaatgcttttaattatgatgaggataccgacattctgatgccggaagaagcagacggattatatgacattgcagaatttatcaactatggtatacgcatgaccgcagcatttttagattatcagaaggatttattaaccgcagattttgatatgcttcttatgaaggataagcttttctctgaatatgataccttacagtacctatatctcatggagtcaaaggacaatatgcgtgatacctataccagcacaagcttcaatacgcaccttatgcctatcggtgttcatgcttttaaccacttagacatagtaaataaaatcatcgatgaaaatatgcccgtccgtgaggtctatgatattaactccgtacaggactggttccgttatgaatttatgtatcttgccaaaggaaatgtattgtataagcaatgcaaaaactgtggcagattcttcatcccctccggcagattggacagcgaatattgtgaacgcattgatacagccagtggcaagacttgtaaagaagtaggtgccatcaacaccttcgtaaagaagcatgaaaatgatgaaatccatcaggcgtacacaaaagcataccgccggatggactccagaaaacgtactatgtatatttccaaaaaagaatttaccgaatggagcaaaactgcccgtgaaaagcgtaaactctgcgaagaaggacagattagccttgaggaatttcagtattggcttgataagagcaagtgtcgataaaacccttgttcctaatgcatatctcgcttttaaacgaaacctccctatgatttgagatgttgttttattataatcataactagctcaaaatgtatttttgaatatgacaatgcgcgcgtattttttaacttttattaatgtttctgagaaaaagaatcagttaacacagaaacgactggattgcaattgaaaattgtaattcttcaccccgtgcaaaagtaaaacatccttttttgattgtaaagaatcagttttgttataaaaaggttacataccactgaatcagtaacaacatgaatcgattccacatcctttttgctagcataaatctattcatgtacttccgtaccagaagaactaatgacttttgtatgtcataactgttcccttttatgatcgaagtgccctcaaattaacatttaaaaaacgaacacacaaaaggtgttattaattataatattccttttttaatccaacaattaaattagaaattattaaagccacaacaattgcaactaacgttacaatgccgctcttttcgaaatgatatacttccccactgattgctgtagccacatcaatattcacaatatttaatggattatattctttcattttgggaattaaattaatcaagaataaaactcctatacaacttactatcaataataagctaacataacctcctttacagactacatttgtgcatataattaaagcaattagaaatacgccaaatagccatgaacaaaatagcaatggcatcactccagtaaagttcacatccggaaaaagtactttcgtgtacaagctacatgaaaaaaagctaactacaagtgatacagtccaattaatgaccaatgcacaaaattttgcattaacaacttctcttattgctaatcctttagaaaacggaattatcaatgttccttttataagctcatttcctaaagtgttataaaatataattacaaaaacgacaaatcctaactgtgaaatatttttaaaatattgagcccaagcatctatatatgtcgggtctggcatttgtagattaattaaatcagttgataatgcaccaataacttcggttgtatactttgctccaattggacttattacgcctaacaaaaaaaacaaaagaacaactatcagcaccttaaatgttgcaacctgttcccacaattcttttttaagatacgcataaaaccctttcattgcacaacctccatataagtatcttccaaggttctttcaatcctctgaattccgttaatctgatattcttgttccccaatccatttaaataattcaggaactatttcctttgtctctaacctaatgaatacatcattattttcttcttgtaattctgcgaacttaataatctgtcgagcatcattaaccaaacgttttctttccgtttcatcctgacaactgactctgattttcacactttcatctgtcttggttaattcatcaatagttccatatcgcaataacttaccattctcaagaatacctacataatcacttatctcctcaacatctgataaaatatgagacgaaaagatgatactcgtctgttccttcgctttctttaataaatttaaaatttctcttctacctactggatctagtgccgacgttggttcatcacaaatcagtaaatgaggttcattcaacaacgcttgagctatgccaagtctctgcttcatccctcttgaaaatcctctaatttttctattcttatcattttcaagccccaccaacctaataagttcttctgccttttccttgcactcttttttacgcatcttactaatttcaccacaaaacatcaaatattgcatcggcgtataaaattcataaaattctggtacatccggaaggtaacctattttagtgtaacaaacacctttcccttttgtaatatcattacccaaaaatgtaattgtcccagaatcaggatacaaaaacttcataatcattttcatggttgtagtttttcctgctccgtttcgcccaacaaaacccatgattgtattttgtaacactgcaaacgaaagattcgaaataacttgctttttcttgaatgctttacttattccttttacttctaatacaatactcataattggtctccattaccctttccaaatacaaagtacaaaattggtccgattatttgaatcaaaagaactataacagtccaaacagtcttgttaccatttctgcaaccatacatcctatgaattccaagcaaagccaaaattgctaaaataacctccactactacaataggtatcacaattatcaataattcaccagtcatcattgtcatcttcccctttcctataaccccaattttttcatcgcaactttcttcgtaatattgtatacataaacttcaataagcattaaatacaaaacggtcatgaaatataacacttgattacttaataagtgcaaaaaaacacattccattggaatacacaacaaaacagatgcacataacatctgcaagggcattgtaatactttgtttaataactgttataggattttcccactcagtacttcccagcaagagatctaaaagaattcctacatttcccataacaattataaaagttattaggcacagaaatacacttatcatttttataatatctatttccttgccaattgcgtatacagaaccaatactatcaattattgcaaaaggtaaactacataccaaaaacacttttattttcgaatgcaatatttttttgaatctaatgggtttgctctttaatacatccaagcattttccttctatagatatgctacaataagtcgggttggcaaccccaaatacaaagcaaattaataaaggtaatactccgttaatttcattcatatagcctgtcttcgttaggtattcatgcattaattcttttggaatcacacaaaaaatcattaataatatcgaaaaaattattatcggagccaaagaattcattgcatatacttttgaactatagaatgcagctttttctttcctatacaatgcttttgaggaagttactccagtcaattttaaatttttgttccgatttgattctcttttccattccaaatttctcaatgtatcaccgtagttacaactaattttatatgctattatcagcaaaagagtcatttccacagcaatcatgattatcaaaaaaaagacatcacaaatattataaaatcccttttgagaactacaagcaatcccatatcctacaagaccagttattattacttccacaagaatcccgaatattccaaaccactttgacttttgaaacaaaaattctagcaaacttccaaacacagaaattaaaaatgaagcaaatatcaataacaataatcccaaaataatatacgttgcaggcaaatttctttgaaaaacataaacaatggtataagaaaaaccaacaacaatattccatctcagtgtcattactactgttgtcattaattttgccaaaacaatataaaatgtttttactggaagatatgaaattagtacatattgttcataatcatataaaactctttttatattaatcccgtaatcgtatattgccgcaacaagagaaagtccatatacataaaataaagaattctcgattatctgcgttttttttatttgggtcagtaatatgcccccatacagtaccataattccaaaaataaagaaccagagaaagagttctttcatcctcacatttttgctcggctttaataaatggatgttcgacatttccattttcagaatattattcagcactttcatttgactctcctactagcagtttttgcaaacagccggaatgatttacatttgcaatttcatcatctatcagaatattaccatttttgattactactactttatctgaaatccttgtcacaatatcaagcatgtgcgaagaaaacaaaatacctacccctctctctcgttcagcattaatcactttaatcagctgttctactgtagacggatccaagcctgtaaaaggctcatccattacaatcaagttaggttcatgaataatagctgccataatcaataatttctgcttcatccctctcgaataagcagaaacaggtttatgtattacatcttccatctgtagcatatataccaaatttgcaattctttcctctttagctgcttttgaaatatcataaaaactactaatcaaatcaagatactgacgtcctgtcagatagtgatacacagcttgattatccggtatataacctaactctgccttacacaatacactctctttctttaatgatttgccattgataaatatttctcctgcatctgcttcctgtgctcctacaatacaccgaataatgctacttttccccgctccattattgccaactaacccacatatttcgccagcatccacttgaaagcttacttcttttagtgcattttcctttcccggatatgattttgatacttcatttacacttaacatattcgtattttccttcattatcaaagcttcctatcataaaaaatcttgtgtatagatttgttgcaattatatcacaaccagctattaaaaacaacattttgaaaaaagcacacaatacatatctgtgagactaatgaggtttagtctctgactttaaacatatacttattttcaactttatcaattactgtaatatcaagccaaacacaatgagttccttctctttttcaatcgctgatattttcccctctatttcaaatccgttaataatcagacaggctactgttcttctgttactgttatacagagaaacttgacattttgcactattataattcttctgcaattcttccttcaatttttttattagattagttgctacagaatgtcgtctagatttttccagcacatgcaatgccacaatcgtccagatttggtcaacattaggactaatcgcagatatcacaccttgaacttcatgactctcatcatcaatagcaagaattgagatttccattttatgttcaatacgcataccaactgctgattcattcatatacatctgttcaatagcagatggtgtaatctcatccttgtgttcgaataaataccttattaacacttgaacatcttttttttcacaaatttgataaatcataatttcctccttctaacctttattccaccacaaaaaatacgcgttcatcaatcatatgctgaataaaagcatatatgtcatccaacaatgtacttcttgtaacgcccttatattcctccatcatctgattagcgatttctccaattgtatgcttaccatcgcactttatgaaaatatctgttgcaacaggattcaaaatatctaacattcctgttaccgggtgttgatatataatatagtcattattctctccatctaatctccatctaaaatttaacttaactggaattttattctcttgcaatgtattcatttatacctctcctatcattaatctttcttctaaagtgtctatcaatgtgccatttcctcgttcatccatcttcttagcaagttctaacatttcaggattatgccaccccatcttcatacgatcccaaatttcctttaaagactcttttttcaaatcaccaaaatatgcatcaatatacggtgatatacccaccaatccttctgaattaatacgtgcaacaattgcatatccatttttaacaccaaattgaacatgctctgcaggacttctaaactcaattggtatccctttaccacgctgattataaataaatgtctcaaatctcctaatctgcttctccgtagcatagatactttcctcatgcccttttacacgaccagatatggaaagtttctgggttcgaaaagagctaactcctaatgactcacataatttatatgtattctctaaatcatcaatattgtatttcgttgtagcaaaagaaacttttacttgctttccttttgctacaaaggccttaattgtagttactgcctcatcaaaagatccttcacgtccacgtaccctgtcatgaatctcacttgtagagccatctaagctaacttgaatcatacttacatattcacaaatttgattaatcttagccggcgtcatgcatccaccactaaaaatacttccaacaagtacaccattagtcctaaaataacgcaacaagtccaaatactcaggacatgccaaaggctcccctcctgttaaacaaacttgaaaaattccagcttcaatcaactgattggcaatttccattttctttttcgaagataattcctgagttcttcggttgtgagaatcattatagcaataaatacacttgttagggcacccgctcgtcaattcccacattacatataaaggtgctgaaaatccccctttaggcaccagattcgcattggcaaattgaatgaaattatccccttctgtaactgtacttatatccgcgttagtatttccaaatacatttataaacttactcatatctttttttcacaaatcctttctctttaaataatttttgcaaatcaattatgttctttacattttgaagtgtttcatctttctgaattatttcccaaccttttgcaaatcccttttgccatgcgtcttgaaaatcagcatattcaaatagatttccatagatatacggaatatatccattcaacattaaatcaccttccggcgaaataattccaccccaattgattttatccttcattccctttattaccgctttagattgatcaacaaatctcacgcataacataccctcttttgcattatttatagcatatttttttgtcactctttcaatttctttttgaatttcatcaatatcttcaaaatttaatgccaaacctttatcgtaggtcatataattcatagctacaaccggttgtatacgaatttcgttcacattatgatttatcatttcttggaccaaaggctcaatctctttcttatttttcttagtaataaccatttcaacactggtaaatattttccccaagccgtatttatctatataggaaatcaacctctttgctgaatcacatgccccttcgcgccctctctgataatcattaatctttgaatttaccgaatccaacgaaatattaaaagccactaacgaatttctacataatctttctatttgcatctcgtcaattaacaatccgggcgaacaaatcattgtagatatacctgcatcagtaaatttttctaccaatctttctaaatcattgcacagtaagggatctccccctgataaagaaatcataaaaattttcatagctattaattcatcagccaacttcatgcgttgctcactagtcatatcattagtctttttaggaaacccaccagagcaatagatacaattagacatacactttcctgtaagttcccaaaccaacgaaatcggtgcctgaaaagaattaagtgtttcaaattcttttggtacaattatttctccaccaatccattgttccaaattttcactcgttacaatcgtcttcaatgcattacctgtttaaaggaacaaataaattcctcttttctttcctttctcgccaaaggacaactgaattcacatcgttcaccacacctttgacattttataaactctgcgcctctaatccaattcaacacagatgaatccttccatatctgcttcatgtctttttctaataaattattcttttcttcctttaacacatgctcgtcagaggggcaaagttttacatctccatatggatcgacagtacaatgtattttcccagcaccgcatgctggcattatcccactggaatcaaatacctttgcatatctgccttcatcaccaatatttaacatattaggagtacataacaccatgtcagtctctccatatttttcgtcaaaccactgtactacatccttataaaatgcacgcaattcctccacatcatcttcttgaaaggccaactgtgtattaaccttagctcttccaccactttcaagaggaactacacacacctctcttaccccaatctcataagccttatcaacaatctttttcaaaccaaaaatattcatttttgtttccattacattgcatctcactggaattccattttcaatgcatgctttaattcctcgaattgttgcatcaaaagaacccgctactcctctaaagcaatcatatgttttcgcatcataaccatccatattgctctctactttttcacatcctgttgattttaacccttttgctaatttatcatcaatcaatgtagcattcgacaaaagacaatagctagctcccttgctctgaatatactttgctatatccaataaatctttccgcatagtagcctcgccacccgaaagcagaatttcaaaaacaccagcatctaaaatattatctattaccttataccactgctgtgttgttaactctccttcaatatatcccttttcgttatatttacagaaatccgcatctgcaaaacaatgaacacatttcaaattacaaatgtgtgttaattcaatcaatacctttaatggcgccgaaagaacatatggtggtaatcccaatgtataatttctatcatacatatcttgcgtaggaatctttttcatatttatacaatcttttttaacatctttaccattttgaataaatttacttgctgttaaatatgataaatactcctgcaaatcatctttaatcaagtgtggatctgcttcatactcgcttaacagatactgttcaatttcttcttgagtctttccttgctgacatagtgataatatttcatatgcagagtcatttaacagttcaattaccaatctatctctttcataatatattccgccgaacgcttcttttcttattcgtcctactatagttggttttacattcttcatcacatcttccattttatactcctcttattccgaaagcctttgataattttaatttagagtcatatcttaaatatttgaattatattagcacatcaataaaaccatattaaccttaaaaaatgtcacactttagccctatcttaaagcaatacatttttcaagatagataacataactaacacaagaatctataccaaaagaatctgtgacatgtaaaaacatgtcacagattagaaaatataataaatgtattttctattactaaattatgtagcgggccatacccatccaaatacaattccaattgcccacagtacaactgcgccaattgccagaccatactcgttatcaacacttgataatcttaatgtggctggagaatgatattctttcatgtcttttcctcccttcaaaatttatataaatcgcaaactgttaagttttcgattcataccttagttgtttatttgctctatataaaattcaaatcttgattttaaataatatttcgaataatcttcccttgctatacactaaatacacattttcactgtcagaataacccgtttcttttcttataacacacttattcttctactaacactaaattaaaacatagcactttttcattgcaacccaactatcataaccaaactgtcttaatcatctactttgtacctgtatatttctatatgtttgccagcataaatataatacgacattatatcaactcattattggtatttgcattcgcaagacaggtacataacagatacattgcacaaaaatcaatcttccgtgctttgattttcttgtattatttactaatttttctgttgacatatttgatataatgtcgtattatatcaacttacaaatcaagtaattccaatcgttttcttttttccgaagatgatgtttttgtataaatccaagtagtttccaatcgactatgccccaaaatatcggcaagctctgttatatcccctaccttttccatgtaattctttgcaaataaatgtctaaaagaatgtggaaacaccgtttcctctggtattcctattcctttggcaatgttttttaaacccttccacaccgcagccgaagttataactttcccctctttcctgccggtaaaaactattccttcccttatgccaacatcattacaatattgcaataattcaatacacaagcgttctgaaaagtatatatacctatattttcccttgttccagatttgggtatacccatctgtgatagcaccgaccgtcacatactttaattctccaactcgtaatcccgttccagctatcgttctcataatatgatacagctttattcttccggtatcctttgcatattttaacattgcaaaataattttccttacttatcattttgtctaaaatatttggtgcctgtatacgctctgtacgcactaccacatctgagaacccaagccatctaagataacgattaattgaaataatttttgaatttacacttgccgccttatatttcttttttaattcttttttatacgaaactatcatttctttcgtaataactgtttcctctactttttctaaccattgcctgatatctgtaagatatttgtgaattgttcttacagataattcctgcaattccatctctttttcatactcccttagcctttcttccgcttgtaccttttctaaatacatcaacttttcctccttgtaaacactacatttctataggtaatattgcttttcgcccctattacacaaccatccgcccctaacaaaacaacaaaaggaggtttactccacacttgtgtaaaaacctcctctaccattacctactttttcctttattctcataatctctttgcaatataatatccgcttcctctcgttgttctgacttcttatccttcgatacagcctctaaacgaataaattcatccagcatatcagcactatacttgtatacaatacctatcgaattcatcttgctaacaaatctgtgaattctctcttgcacatcacaatcttccagaccaatccattcaaccttttccttatccgtcagagtttcgtatcgttcctttgtcatctccggctcatttaccggatgataagtttcttccactacttcctcagcaacccgctctgcaaatccctctgtatcctctgaaaaagcttcggataacggaaccgtttctgataccggctccgttatcgtttccgatactaaggaaactgttggttccacaaatggctccgttctctccgccggcccataaacggtgctttccgtttcaaccgttttctcctcataggcttcatattcaggataagaaatcgtttcactctcaaactccggcacatccaccacataaagattctctatatccacatcatctggtatctccaaatgtgcgtaggtactttcgcttagacaacggttaatggttccaagctcacttttagcttccttacgcttctccttaagttctgccagctgttccctgtagtgtgcttcgtgatacagataaacagtaacatccccacccttttcatactggtacttttgacgggcatgttcgttataaagctccttcttttttgcatcaatatcagctatctttctctctgccacacgctttacatcaaacacatcattccacccgtttataccggtacggttgagaaaaagatactcctcctgcaactccttcatacggataaggtcctgctgataccttgtgtacttatactgaaaacgatacttctgcaccacacacatccggtacagtttcccataatatctctgctgaaatgcattctttggtttctttataagagcatatcccggctgatatactggtagtgccacatacttgtaagggtgcggctgttcgtagtattcctgcaaattctgtagcgaaaactcttcatcaagcgtatccaaccttctgcttcgcctcatgccatctgcttttacggaaatatgggcacctacctttacctcatagccaagcttttccataaggaaaacaaattcttcaaagctttctgccttattcctgcaatacagcatatctcccgttatgaaatctttccagctctgctccttctcccactgcttacgattcatattcacagggtccttactgtactccgcagccactatggacaagccgtattcctcacacagcctgttggtaatgggctgtatgatatctttccagtccccttttctatagtcgtacttcctgccgttaatcatattcacactgttaaacacaagatgtgaatgaagatgatccttatccgtatgaacagcaaataccgcttcatactcaccacctaaaaattcctcggcaaacctttgcacaatgtcatacatctgctctgtggttccttctcccggctttaaggatatgataaagtgatatccctgcctgccaccgacctgtccaaacatctccttcgtgcctatcatctgctcgtaggcataatccggcaggcagtttataccgcccaccagacttctgttctccgtcttcgcctcattgcagatatattcaagagaatgctttaagtgtgccgccacattccccgcctttcctgccttcatatacataatctttgtaattgccaaacctatctccacctttctatcagttccttaagaagctccaaaactgcatccaaagcctctttcatcctgcgtgcatccgtactcccaaaccatccggtttcattacagtgctttgccatctgattgatattggtggcaatgccactaacctgcctgataaggttccttctgtcctctgcgtgcgttgcatccacaccgccatgaatgataagctcgcgcacatacttactttcattcatcctggcagcctttgcaccctcggacagcttccttgattcataatccgacagacggaaggttcggttctgccttgccgtccgactctttgttgttatctgtttctccttcatcgtaaattcctccaatcattaaaatctgttgcttatctgttttctgttccgctcaatgctcccatgcatttctacaggaaccgcttctgaaatctctccctaacgaaatggacagaatttctttcagataaaaactgcaagatacggaaatcgcaatgcgtttccaatcttgttaggggctgttgcccctaaaaccccgatataaatacctatatttcacgagaaaatatccttttctgcatatttcctgtaaaacaaaaagcaggcatatcggcaaaagcgttaaacactttttgccaaaatcctgctcttgttatacagaccgttatacagataaaaagggcaataaaaaaactgttaaacacatttgtcgtttttcttcctaaatgtttaacagtttctatcacttttcctattctgttttacggtttgtttgacagttttcagcctaatcctcgtcatcatcatcgccgaacatggcagccagagaggcggcagtaccaccatccatcggttcatctgaataccccagcagattttcaggcaattcatactcctcttctgcggtttcagtctttgcggattcggttgccatctctgttggtgtagtctgctgtaccacattcacaggcatagcctgcatcggagcgtagggcattggcacctgcatctgcggataacaaaacccctgatgccccatagctcctacaactgttgcaagggtctgagtgattgcattctgcacaatcttctcgatttcaaccctgctctgctcggcatagtctttcacaaacctctgcacggtttccaacatatcaagctgctccctgcttttcgcctctccccgaaggaaagacagcactgcccactttaatgcttccgtataagattcataaatctgctgttgaattaccacctcgtccaaccagtccataatctcctgatcctcacggtttttcgggttgatacgaaacgctactgtttttgcagccatagctccaccccctttacaccagattctgtgcaaggtactgataaccaagagcatttgcacggacatccgttacatatctcacattgtcaccggtacagcttccaaaacgcctcataacacctgcaccgcctccgacatacaccacattggtaaagtcaaagtcgattttcagttcacgaagttttgcttccacctcaagagcgtaacgcttaagacccgcattaatggtatccataatggcagccttattgtttgcaatggcatcggtatctcccttttcaatcacctcattgatgatatactccggaatctcctttccatggactgcatagcattccttctgaatacggtcaatggctgtaatcagtcccagctgataggtgtggcagtcatcaagcacaggaaccttatttactaccgacataatatccaacgtccaggaaccacagtcaaccgctgtcagtctgtccatgccatccattcggtttgcaatggctgcgtgacactgagcaaataccctgacctttccaaagtgaatgacatatctgacgccctcataatgaaaccctaccttatcgttagctctcagatagttcttaaatgccttcttctcttttccgtacagggtaagcggaactccaacagccaaatccaccttttgcacggttgaatagccaaccctttttatctccctggcaatcgcaaccagcgtcagcagataatagttgtcattctccgtcttagtttcctgctttcccattcttccctgaccaacaacataaatctttcccctgtattccagtacattctccttcgttgccggcatggtcttaagttccttaattccattctcaaaaatgaagtttggtgtctttatggaactccagccgtggtcaatggcaatcagtcttggcataagtccgtctacaagcttaatgccatttgcttcgtttgtgttcatgttacttctttctcttatagattctctcatataaacctctttctccggcaattcgggtgccggtcccaaaataatcttctaccgataaaaggtggcagctaagccaccaccttcctcttaaactaaacttcctaatgatactgataaacaatatctgaaagcactacttcttctgcaatgctttttgcctgttccctgagcttccacatttccattgtggagccgggatgttcaggcggatgctttttcaaatgctgactggtaatggtatcaagcattttgtaagcctcttcatttacctcatgtgcctgactgttaatacatccaagccttgcaagggttctgtacctctgcttatgattttccttcatataggacaaccacagcaatccgtacttccctactgccgacagctccatatccttcggaattgtcagcaccggatataatattccgtccctttccacataaggaatcttaatccttcccatggcatatcgccccctttcctaaaatctgccttaacgatagcaccgaaactcatagaaatccgtatgcgtaccctgatacactcctgcacattcaatgtaaaaatacgggtctacttccagtaccatcattccggctatgtaatccgctatctcttcttcactgtaaagccttcttctactaatggtggaagcaaggttcagattagtttccacaaatacggaataataaccgcaaccatcataagggtaatactcgttgtattctacctgtgtaatcttcccctctgccaacagattgtccagattttcaggaagagaaatcatccctgccgccttacacttatcaatggcaagtctcgccacacggtcagcatcataccctacatactctgcctgcggtatctcaaaggtaatctcaaataccggactcccgtcagcaggattgccacggtcatctgtctcagcttcatctgtggttggtgtctgcgtagtcggctcctgcgttgttggttcctgtgttgttgcttcctgcgtttgcgattcttcacttacagatggtgtcggagtagattgctccgttgaactctcctgctgttcagttccctgtggattaacaggcatatcttcctcggaagatgtctgcgatgtcgcttcttccttttctgtttcaacaacctgctcctgctcagtcaaatccgtgttttcttcggtagtggctatagcatcttctataatagcaaccgcttctgataatatatccgtctctgaatctgatacatcctcagtcacatccacacactctgtcatatccacagtaccgcctgcatatcttcccttacagccctattagaacaccctacagccaccataagactacacaacaccaacattaaccatacctttttcatcatacaaatcgctcccttctactgtggtactgctgcttttgcaaaaatcagaaagactcttgcaaccagtacgaataacaacaaaaacaactttcctccataaagaactgccttcaatacaaaaagtacactcttcaaaaggaacttcactactgcaatcaaaatgcttcctaatcccatacaggacctcctctctaagcatttcccctacaagtgaccaaacttaaggaaatgctgtcactacttgttccaatgcagccacgcatcggaagggtaaaaaaatacaccatcccaaactaacttcttatcgaagtctaagcttaagatggtgtagtccatacccactcttggtttcatattcagtttttacaggtgcctttctccaccttttttaccgtaactgattaaaattgatacaatggactaacctctgaaacgccctatttataaggctttcttaagcttgtcactattatatctcaatcccctgtttcccactttgaaatagtcttatttgaaactccaagtttctccgctaattgttcttgtgttaaatttttctgttttctctttaatgctataaattttcccgtaactgattgattcatatacattcctccattcattcgatgatataaatatacttctttcatcgttgaaataaaatcccttgtaagtagaatataggtggaatctctgtttctcatatatttctcaattcccccagaacaaaatccacctgtgtttaacaatattgtctttcatcacaatattctctcatcaggttttcatcttgctggtgattcctcaaaccaatttttctatttattccgaggtctcagtacacactagaacaagatccatcccggtaataccatatcgctattttagtaatatgatattttccggacgtaggaatcttgctgaggattgtgctccccagttcctcacattcagaataaatatacacttggtttcccgaatttttccggtcacaacacagggatataaaataggctaaatatcactatacccctgtgaaatcactatgtgattataaaaacagtaaggacagaaagtgaggatacacttccgcaaaattgccaatttgggttccctaccccaaattaaaaaacgtaaatttatcgtcttgttccattcttatcaaaattcttttttaatgctatttctgttgggagaatagacccaattaaaggaataagttgaacaccacagataatttctcctatactcccaacacaatcttcattttttccaatcactaaaagcatgaacattactgttatcggcaacataaccattccacagacataccagactttaccacaatatttatgagcaaattcccatgtgtctttgttcttcatagacatcgaagtccgatatccaaatactgaatttatttcctttggaacctttttcataaaatatcttccaaaaccaatcatcgtaaatggaagaagcaaatccataatcaacataaaaatccaaacccccattgcaaacctcctttactacaactttccgatttgtatgtctctattataccataatgatactattataaaaaaggaaaaaagcagtaatgaattttcttaatcattactgcttcaaacaactgttctcagggggaatcgaacccccaattagcgcttaggagcacgatttagtggtgtaaatccccgtcaagataagttcgtctatgtcaaggaaagccttgattttactaactttcctgtcaattcgtgtcaaaataagaaaacagaaattccttcgagtaaagcgctcttcggtggcaaccaggtgcctttgccaccctgaggattcaaccattgcgttccatcgagttcatatctatggctatcattcccacaagccttgcagtaatgataacaatattttcttattagattactcttattataacgtgtatgaagccggatgtctatgattttttgaccatcattgacttatttttactgatattatctcatatcatacttaacaacaatgttttctcaaataaagtactacaattattaatctattcatcactaagactcgtctgtcggtactaatttgcttccttctcttttaaatctccatattttacgaatacactctttagatacatcataatcacgtttcaaaaaaattattggattatacattggaagaaatggtcttattctcatctcagaataagctaatgcattaatagtatattttaacaatatatctgtttttctttcttcatcaatagaagcatcaaaccattctatatcaattttattcagtgggacctcaaacgacacataatagtttgagcagttatcagcataaccatcagcaatattataatcattataaaaaatagataaacttttcaaaaactctggtgatccaagccacccctttacagtttctatctcaaaggcatctacaaataaatatccatttacattgtaatcattcaatgttcctgcaccacccaatcgcatatttatatttgtcattccatgatttcctgctgtatcaactttatttccatgtctatatataaaaatctgttttccatcaaatacaaattcaaatcctaattcttttagataatccgataacgcagttttctttgttaacgcatgagacaaagtcaataatccctcgtcccatattgtctcttcacattctctcggtgtaatatgatgaactataagtcggtctataacttgtggatgtgttccacatttttctataagctttattagcgacatattttcgatgcaatattcattatatccgcagccaacaatatcatctgcattctctttcacatattcttttatatgttctatatccgttcccattatttctgcaacggaatgatacatttcattctttcccaaagtatttaagaacatctttcctccatttctcagctggcatatactcaataatattctctggagcaatgactgtttcaggattcatataagcatatacatctgaatgcaaatcgccaaatgcacaatctattgcatacgaaatcaaccatcttcttaatttaatccaattattgcttctatcttcttcaaattctgttttgttgccgtagaatgaaaaataagcataatcactaattgtgcctttatactttacaacataaggcttacatatttctttccatttcgtatcaatccccgttgtctcttcatttaatgatgaaagtgtgaatagaaattctggtgcctcatgtatcgttgaatattgatatatgtccctacaaaagaaaaaagcattaacctgataatcaaaatataatttatgtccgattttatgtaattgattttttcttcgagacaatacatctaaatccttatatttgtcataatcaatatcgtatacattttctccgacatacacacatttattatctatatcaaagctaatataattttgttttaggaatcttctcagctgcgtatcattttccaatacccactgtaaattatgaagtccatataacttaatttcattacaatcatctacacacgttgttacatgaaatgcagctatttccaacttttcaatatcaatcgaatccatcactatacggtatttctcataaaaagcattaacatccttatggcattccaaacaataagcatctattaagtcaccttgcttcatttttaatgcttcatataaccagttatatgccacattcggatttgttatatcatataaatatctgctcatagcactattccttttatgttctgcatttatattccattgtgtaacctttccacatattcaacaagcctatcataggtcataatagttaccctcgtttcactttgcatttctcctctcagctgattgcttatttcatccatcctatcccgcctactaacaacaaggcagtacctaaatccccaacttggaacattattagcaaactcttttattccttcagaagcaaaaaagtatgctctattctgatcaatccagcgtttcaaatctctaatttgattaagaccctttcttactttttctgtctctgcatttgcagttttaatcctaaagtctacatttacatcttcaaactcaacaaaaacaaattgatatcctagtgaatttttccctaccaataaataatccaatcggtactgtgatccaagctgaaattctggtacaacacatgaaaaatgatgtccaaaatcatatgcttttaatatcgataatggaataaaccacttttgattactttttatatatcgctgcacatcgttttctttctttgcttcattgataatatctaaaaaattttttgcttctttatcacaatttatagcatgataatcatcaatctcatatactttgaaattcgatggcaatttcgcaatttgtaattcttccatccgcaatcttcctccatatataaatgttattttagcctcttatacattataatatcacaaaaacagcgatatcatataaatgatttcatcatctacacaatatcactatttcttttatatattataccttcatcgtcttcgccaccgctgtaagcaaagcagccatctccggattagtcaaaaccttcataagcaaatcagcatccactccctcatgaagttccaccgcgctgctgctttccgtctgatcacgcatctccggattaaggttctccttattataaaaggcattttccatcagctccgcattctttcttcggtcctcatcaatgatatgaccatacacttccgttaccatatctgcctgcgcatgacctgaatctccatgaactgctttaatatccccaccactcagtttcagcttgtaagtaacactggtatgccgaagactgtgaaataccacatccggcagtcccagtttatcaataatcctctgcatctgatctcttaggtagctgtccccgataggtagtccaaatgttgttgccatcaccagattataattttggtattcactcccaagtgcttcaataatctcatactgttctttctttagatctgccagacactgtgctacatatcttggaatatagactttagagaaccttgagcagttagaagaaaaatggggaaagaaatatccatcttctgtatcatcatggagaaacaactggcctcagctttcaacatatttcaaatatccggcagagatacgaaaactgatttatactacgaattccatagagaatttcaaccggcagctaaggaatgtaacgaaaacaaagacgatttttcccacggacgatgccctgtttaaggttctgtatctggcaatgtgtgacatcaccgaaaaatggacgggagccggctggaactggggacagaccctagaccagctttgcatctatttcggagaccggatttcgccatccgatttagaataaagcatgtaaaagcataggaaaacgcaggctgccgttgacagcctgcgtctgttgtgtaaaaatcatccttataggagccttattaaggttactcttttttttaccaccgatagcgaataagaatttccagctaatttatgcttgacttttcatagctggtctccagcaaattcaaagcttcacgagctttgcactttcttacaaaagaaccatccctcctaccgagccaatgggacactcctcgtgacaaaagaaacgtccccaattattaacgttaatctttacttgtttttcttctaatccctctcctctcacaaccagttctatctcgccaggttcataacctgcacgaatcactgcaattgcttttccgtaaaaggtttcaaatttaccattgtaataattatgatttgtacagggagttgcggaaccaaatccctgcaacactcctgctccttttacttccacagtaagcacctgatcggaattaactttcgttattccattatcacccactaagtcaacctgcacatagcatagatcctgaccattgctgttcaatgtgttcttctcagcagtcaatttgagattgctttttccggttgcacttattaattttgctgtgccgatttctcttccctgcctgtcataacatttcgcaataagctcgcccggttcatatgtaacccttttaaaggttgctttcattttattaactttacttcgacccacttttcttccattgcaaaacaattcagcatactcagcggttgtgtatacaattacatctgatttatttccttcgcagccatcccaagaccagcttgccacagcgtcagtatttctccacatagaagctgctctcttacaatttgtgtacttcattggttccacggcaagaacaggagtatcctgcaatccccatatgagcttattccaacccacttccggtctcatatttccgcagatatcaataacaccacaaccggctaagatagggagccccggaattgcatttttccttgtctgtttgctcatatatcgtattgttccaattccggtttctccgatataatcccatcccgtccacataaagtctccaataaggttatcgtttttcttcacatattgccaattatcatacagagttttgggaagtgtttccgagcccacaatacatctatccgaattctgcttttgctctttatcatatcttgaggttgcatagttatatcctgaaatatcaagaagcggagccagaatatcacataccttatccgctgacggttttgctgccatcttatcaataatgccacccattttattcataaggatattgtaaaaggtactggtaggcatactatccatggacatgcttccgtttttgttttcttttccatcttttttttcaccgtaaattcctgagccctttgcagccattgttgcaagaagcaaattaataccacaagttacagcgcgttttgaatcttttgcttttacatattcagccatctccttgcataatgactgccccttctctgtcccaagctctgaaatctcatttccgatggaatacatcaacactgaaggatgattataatccttatcaatcatggcttcgcaatcttttttccaatcatttaagaaatcgttgtctgcatgatcatatggattcttatgaatcaaccaataatcatatagctcatccattacatacatacctatctcatcacatgcttccagcatttccttggaaattggattatgtgaacttctgattgcattaaaacctgcctccttaaggattctgactcttcgatattccgcatccctaaaattacatgcaccgattacaccattatcatggtgaatgcaggtacctcgaataagcgtattctttccattgataaaaagtccttttccactccactttattgtcctgattccgaattttgtttcttgtgaatcattcacgattccatcattagtaagttctacacagcatctatataagtagggggcgtcctcatcccataatttcacatttggaatgacaatttccacatcctgacctttgccttctgcaacaaggctgtccttgtcatatatttttacattaatatttcccattccgacaaaatctgtcttcacactgattttgctttctgtcagagtatcaattttcactccatttggcttaatgtaatttttttcagatacatagaggttcactcctctatagattccgctcccggaataccatctactattcggggtcttttcattgtctgctataatttcaagcatgttatctgctttcaaatagggtgtcaattctgtataaaaattggaatacccgtatgctctttttcctattttatttccgtttagtataacagtagcattgtggtaaacaccttcgcattctaaaattaggactttatctctccattcctcttccatatgaaattgtttctcgtagatatattttccaccgtcaaagtatgcacaggctcctcccgatggattctctctgtttctgcgctcataaatcatagcatcatgaggcagattcaccttttttttactatccgaaccttctttgtaataggtccattctctgttaaaatcgtattttatcatttcattctccatcctttatttgttctcggaattaatttcaacgaatcaatgtattttaagaaagtaatcataatacatacgaatgcaataataccataaagtaataccgtggtagtccaagcactttgactattaaaaccgccaaattttccaatgattgaaggtgtaatagttgcaacaacgagcgttgccatcattgaaaatacacttctgacagcactgacagagcatctgtcttctgaagtcagagaaaatcttggcaacatagaatgatatgcgagattaacggcggtatagcagattaccgacatcaaaaaatatgttactgcaatgtatacctcctagtataataatggtgtagtcaatcaagactacttggttaataagtttctataaatcagataacaaaagaagggattcttccttcatcagatgttatccataataattatcatgtctgacggttcctgatagacaccagataaaacataaggtattatctcttaggataggacaaagaatgttcacctccttgggaagtcacttctgtgactgatacctgcaataaagtcaattagtccattcgacagggttttatgttttagctggttgggagcctgaaggccatacccgaataacacgctaggttgtgtacctgccagattggaaatggattcctatcagaaaggggctattgctcatgtcaaacaaatttatttttaatcttgatgaactattcatctctgttggtattgatgtcggtgctgatttctcatggatgtctatagcacttccaaaccaacaattcgtaggaaaaccttacaaaatcctacataacagtattgattcccttacaaccgctgtttctaaaataaaagaagcagaagagttgtattctttggaaagtcgcattttcctcgaatccacgggaatttatcattacccactcttctgctatcttcgtgataagggttttaactgctcggttattaatcctatcatcactaagaatagcacaaatatcaacatacgaaaagtacataatgatcgttttgattctaaaaaagctgctttggttggtttgaaacctgatttaaaggtttcacttatgccttcagatcttgctctaaactgccgtaacctatgccgtgaatactacgatttaatggataatcgcagtgcctatgtgaataagcttcagggtgaattacgcatggcgtttccacagtatcttggcatcttttccaaggttactatcaacacttctcttacattattggagacttatacctctccatcagcttttcttaaagcagacaagcaagagattattgatatcatcaaatccacagctcgatttgggcttacatatgctcaaaataagtataatgccataattcaggcggcaactgatgcaaatcagtttggttacatcatagacagcaacatcaagcgtattcgcctttatatcagcttcatacgtaaatatgatgaagaaatcaacagcattcttgaatcactccacgagcttgttgatgctaatgaagattctgactttgtcaagcagattcatttgattgaaactttcaaaggtgctggtttcttgtctgctgtatccattatgggtgagatcggtgacttttcagcattttcaaagcccaaacaacttttcgcttattttggtcttgatccagcagtaaagcaatccggtaaattggaaggcaccaaggttcaaatgtctaagcgtggttctgccatagctagacgtgttattcacacgttaaccttacaaagcatcagtatctcccgtaatagagaagctaaaaatccagttcttcgtgagtactacctcaaaaaatgtgactcaaaaccaaagctcgtagcaatgggagctgtttcacataaggtatgcaatatgatatttgcaatactcagagacaacaaaccattcaaaatcattgctcctcaggagcatatcaaacaatacaattctgctaaatgcgtcatagctgcataaaatactatgaacccaatgaatcaatatctttcaaaaaacgatattttcaccaaggggaaagtccgcccttttttagtcagaaaataaaatagattttttctcatttaactattgacatttattagctggacttcatatcttccgaaaacgctgttggcacaaagaataccaatagcacgggcaaaatcagtggcaatcccataaatagaagccacggtcttgctttgccccatctggttttcgttttgtcaataatcattcccattacaatgtcgctaagtccgtcaaaattctgcaaatcagcatcattgttcccacaaatgatgcacttaccagtgcactatccgtataatacatagtcaaaaatgattatggcaaaatccagatcagatttacgcccacatctccaagcccataaagaaccttttctaaaaatgttgttccaccaatttgtttttgtttacccatatttatcttcctttctgaagcagtcctaataaatgaaagtaaaaactattgtttccaaattctgcttctttcgttttttatacctctataatccgtttttttgtcagacttatcaatttcaaaaagcgtaatcatgacaaattgagatttaccaaatccgttctatctgatataataaatgaaaagaagaattttttgataatctaatctgtttgtccttaaaaagataccaatggagatgtgaaatggaactgaaagagaagtgcgatgaatatgtactaagaaatgttaaaacaattgatatcgctgactatgagagttttcttcagctaaataacaatcaggaacccgttttaaccggtctgcaccgtggactaagggacctgttatccgttcacgcctggacaacctcccccgaaggacatcagaattacctttattttcaaatgaacggtgagcaaaaattttgcgcaactctctattacagttcagaaaccctttgccagcctcatactcataactacattgaacttctctatgtcatgcagggtgaacttcgcatgcaaattgatggaaaaacatattccttcaaagaaggggatatttgcctgattaataccaataccattcattgtgaatacatcgaacgaaaggatagtttcatcatctgtctttgcacggacgatatcatctttgaacagtatcaaaactctcgtagtgcaaaagactacacattaagtttaaaaaggtttattaaccaaaaacgtatgcaggaattatttgtatccttttctccaagaaatacagatacacataaaacaaaacacgcattcgagacaattatttcagagcttatggaggatttacctgggaaacaacgaattgtgattggatatgtagaaagaatcattgatttacttgccagagaatatagtattcaggcaactcgttcagataaagaagagttacagaaagtattggtgcagtccatttgttcctatattgaatatcactacgactccgttacagttaatgaattatcacaaaaattcagttacagtccggattatcttacaaaaatatttaagaaggagcaggaaactaacttatcagcatacattcaattggtaaggcttcagcatgcctctgaattaatcagctctacatccttaccaattgaaaaaatcagtagaaaagttggatataataacgtgggattcttttataaaaaattttatgaaatctatcagacaacccccaatgaggtgcgtgaaaaataaagaacgcacctcattaagaccaaacttcctgtttaggattcacaaaagaaccatccctcctaccgagccaatgggacactcctcgtgacaaaagaaccgtccccaattaatataatcaagatgtattagtgcacttcgtcaattcaaaactgtcaaatatatcaaagccagtcagctcatcaatgagttgtcaaaggctgaaaaactggataattaccaggaagtacttaaccagtatgcagcatatgacctgcttgctgtagatgattttgggctgatgaacttggatattaacaaatgccgtaacctctttgaggtattcgacagtagggatccccacaagtccatccttgtgatttcccagattccggtagcttcctggtatgatatgttccttgaacatacatatgccgaagcatgtctagcacgccttctctctgacgcatatcgccttgagatgaatggtcgtaacatgagaaatatagaacctattaacaagcagccgtaaacggctgtcaaaacacaccgctggcgcgaaccccttacaccgctatcgcgagaaagggggggccgtttaagcgaatttagcatgtatcggtagatggtttgactggatttgtggatgctatcagtgcagtgttcccaagagcagaaatacaacgctgcattgtacatcaagtgcgttattccactagatttgtaaattacaaggacttgaagccttttgtacaggatttaaaggaagtatatcaggcatccactgaggaacttgcactagagaaccttgaccagttagaagaaaaatggggaaagaaatatccatcttctgtatcatcatggagaaacaactggcctcagctttcaacatatttcaaatatccggcagagatacgaaaactgatttatactacgaattccatagagaatttcaaccggcagctaaggaaggtaacgaaaacaaagacgatttttcccacggacgatgccctgtttaaggttctgtatctggcaatgtgtgacatcaccgaaaaatggacgggagcaggctggaactggggacagaccctaaaccagctttgcatctatttcggagaccggatttcgccatccgatttagaataaagcatgtaaaagcataggaaaacgcaggctgccgttgacagcctgcgtctgttgtgtaaaaatttcttcatttattaaaatttccaatcatttgatcaataactttttttattgatggctcaatattttcaatcccctccggctcctgtacatttgctttgggttccttaaaagctcttccatttctccaaaatagagctcttgtcttccatgccacatatttttctatggccattttgctgtccttatattcttcaccacaacatacacatacaaagataacatgacagagaagaacatgatcaagatatatgtggacgcaagctcggcaaagagagtagatattatcatcaagcactacacggattttatgggaatcgtggacggatacacggaaggactcaggtacatgatcgagtgtgaaaaagaaagcaacagtcatcaggagatgggagatcttggtatcagagtccagacaggaggaacaaccagtgatccgacagcaaaaaaggcaatccgaaatgtcatgacacttgaggcacttatcaactgtgatttctccggagatgtaatggaaggtgtgaaccgtgcagaggaatttatcagagatgcctatctacttcgggacatgagaaaagattatgatctgttcaaccgtcagctatccattcttggaacagaaaaggagacctttgaaaaatatctccgcagggagaagtcactggatgatatcgcagaggaacatgggatcacttatgagtctgcccagcagaaaatccacaaaatcagaaccagggtaaaaaaacaggttgttggtttcatggattgaaagatgggaggtattgcgtaatggaagaaaagcgatgctataccgtcaaggagctgcaggagattctgggaatcagcagaccgacagtatatgaattattgaaaagaaatgaattccgatggatccaggttggcacaaagtaccgcatttctaagaaaagctttgatgaatggctagataagatgatggaaaatccgtaaatttgccttctaaagcatttggatgtcagagtggtatagtgtgagcaaaaggaggtaatggcaatggataattcgatggaaatacaggatatcaggacaagattagaacagtttcaggcaaataaggatcccagactgaaaaatacaatgtcagtgccggagatgcgcaggctgcttggattaaaaaagacggaaagctactggctcgttcacaggaacttttttgaaactaaaattattgacggaaaaatgagagtagacattgagagttttgagaaatggtatgcgaaccaggtaaagcataaaaaagtcaatggggaggaacccggagcagaactgatgaaaacatcttattcttttaaagatgcggctaaccttttgggaatcaactcctctaatctgtatgagatatggcgggatgagaatctggaaacgattacggttgattttgtgaaacgtctacctatagaagtattgccttgtattggctgtgattaactgtgctaatcggaacacatcgtttttatgtttctttatgtttttgctatcgacctgctctccattcaacttgcgttcctttaaatcaagccatgctttcgccttaaatggaatcaagcaagtcggacttaataccggaatgccatcaatcatcatttgtccggtttttaacaattcataatatgcttcatttaaaaggattgccgacaaactggatatttcatcatctatcggaagtggagtgagaactgcatcatcttccaatataataaaatccggatttctggaaaatatttctatcatatatggatattctttacttttcggagatgtgaaacgataaaactgtgcatttccagtgcttttattcaaatgctcatatcctgcttctttgacatactcccaaaactgcctgccaaactccgctgttatggattcaacaatcaatacaatatctacatcttttgtagcacgaaatggtagttcttcgttttccataatcaaatcacacgctgtcccaccgatgatgacatattgattttcaaaaccttgaaatctttccttaaattttgtaaatccactgaccattactcatgcaaccttctttcctgcaattcatctactgcttcttcaattctttcatcatttgtatctgtaaaagataaaacaagtgaaatatcatcagcactgttatcctctgaaaattgttttgggttgtatgcccataattcaaggctgacctgtttatccgggtctatcaattcatcagtcagcaaggatttatcataatctttctcactaattgcataggtaacaactcggcttggatttagcattgttttttcagaaagtgccgtttcccctgcaaagaccatattttctgtaacttgcgtcttatctatatatcctgtttttcgaacaggagtcgtcaaatatacttttgctttttcaaataattcatctcgcttatattttgactcaataaacttattaacaccgtcttttgctacaagaaacaaatctgtcgtttccaactgcttcactgctctggtcaaggtcattgctgtaaacggaagcacttttccggcttctgaagtatacaatcgttttttcttactgtacagataaaataaaaacaactgctgcgtggagtaaacaaacttaccagtcagcttttggggttctttttcatcagaaagcattgtcccaatgaaaggaagaaagacctgcttatcagtaataaacggtatattattttctataaggctttttcttcgataatttgataccgttgtaagttcaaatacgactggcacattatcaatctgctgtatttttacaatttgttttttcaatgccggaagtgtggcaagttcttctgttggagcaagcattatacagcatctgtttccaatatatgctgtatgaaaatcataactccctgcaatataaacaggcaaagaatcctgatgattccatgcttcatattttatagaaatcccgaatacgcttgtaagcatatttctcattctccttttaactcaatttgttttattttaacttagtcaatgttataagttaagtttttgagttattttgaatttatatttcctttttccgtgacctgctaaaggcgctttcatcagaaataaaggcttagtgaatgacttattccattttcaagctaaaaggcttccgtttttgctatccggaatgaataccttccaccatattttttcatttgagccgaagataatatcatattatgaaaacggaaaaaaagctcatctacgaggtgtgtgtcaatcagacaaagacactcctttacatagtttccactttcaaaaaataaaaaaatttgtgtttttgaaagtgacatcttgcatatactattagcaaacagtatactaagtacaacgaagcagtttcgagaaatgaaaaaaatccaatttttgaaagtgggtgactatatgaaaacaatcacgagaactaaatatctcgatagaatcattgaactgaatggcactcctgacatcaagatcatcacgggtattcgtcgttctggtaagtccaagctgatgcaggcgtatattgagtatctgaaaagcaactttgaaaacatcaatattatcttcattgacttcatggatttagcatatgaagaaatcatggaataccatgccttacacgcatatgtggaagaacattatcaggaaggtaaaacgaactacctgtttgtagatgaggttcaaatgtgtcctaattttgagctggcaattaatagcctgtactctaagggaatttacgacatctatgtaacaggctccaatgctttcctgttgagtgcagatctggcaaccctgtttaccggacgctatattgaaattcatgtgtttcctttcagtttccaggaatattgccaatattatgatgatgttagtgataaagataaactctttgatgattacacaatcaaaggcggtttagcaggttcttacgcttacagaacagaaaaagacagaacaaactatatcaaagaggtctacgaaactattgttacaagggatttggtgcagaaatatgctctcccggacactttggttttacaacgtctgagcgaattccttatggataatatcagcaacctgacttctccgaataaggtcagtcagctactgacagcaaatgagactccaaccaatcatgtaaccgtcggcaagtacattaagtatttgtgcaatgcttttgtattttatgatattaagagatacgacatccgaggtaagaaataccttgaaagttctgaaaagttctatttgtgtgacagcggtattcgatatgcaatactgggaagcagaaatatagattatggcagagtatatgaaaacatcgtttgcatcgagcttcttcgccgtggatacgatgtctatgtcggcaagctctatcaaaaggaaatcgactttgttgctcagcgaggcagcgagaagttttatattcaggtcagcgacaacatttccgggcaggaaacatttgagagagaatgctctcctctccttcagattcgagatgcttatccgaaaatgattattgccagaaccaaacatccacaatatagctatgaaggaattgaaattcacgatatagccgattggttactacaagaataagcagggcgaaatatctccgtcattctctttttctttttgccaaatactgtaagtataactcctgcaaacataaccactacaaatgaccatgctgtgttgtcgtcccctgtggaagtacttttatatgatgtaataaaatggatagcttgcaaagtcaagtaaactatccattttctttatcttaacgcaataatcttggcttgtctttgggtgaattatcccttgcggttggggttattttaatatcaatttctgctctatgctttctgacatctgcaaagagtcttctgaaatcatcatctatcgaaatataatttttttgatattaaattgttgtgagttttgcaaacttgaattgagatttcacctgttttaagagatttaataactgttatattttgttattaaattctccacaagcccttgaaaacactggatttatcgcaggtgagcttttccttattgtttcccttgtgttatatcgtcccatcagtgtttacgaactctgataagggcaaatacaagggcaagaaaaatctataaaacagtataacacaaaataaaagtgacatggtgaactgattgaaatgcttctgatttttgtaactgataattgattgaatgataaggagagataagatacgatgagaacaatatttgcagaatacaatccacagcgcaatagtattgatgtttacacctctgctggctatatgctccgcattgattgctgggaagctgaaaagaatttaaaaactacacccggatcagactgtgcattaaacgcacttgctattgatgaaccacttgaatatgtacgattatatttggacgggaatatgcagatgtgggtagatgcagaagattcattagaactatggtgatttttcgacggtgtgaaattttttctgtaaattcagatcttctatgataattgatgcggcttaacagcagttttctgttgttaagccgttgtttatttaatagcaaaaataagccggtatgtcaagagcacccagaaaatctgaacgtacatttactcttgatcatccggcttattttcaacagcactaagattaccttttttaatattgtttgggatactccctccataaccgtcacatcaattttatactttacttcgatttcaactttttctggtggattgactaaaagcctgtcaatatcattttcctcaacaccagccatttttgctatcgttagcttggatatgccataataggaaacaagcagttccaaccaatgcaccaatttgatatttcccttttaccgaatccttttatgccttaacatcacaacttcctccgatagatggagctgtacctactgcctgtgctacaacattctctgtaatgcttttcatatccgtaccaattgcaaatattgtgcgtctatcttcctgaattttcttcatctgctcttttctttcagctctccgttccacaagtttttgttcattttctttctttttctcgatttttctatcttcataagcccttttttgttcttcgcttggtcctgtaataaccatggagcccatattaccatccttatctatccatatctgacgatacttaacttcactaccagtcattgatttaatcattgagtcagcccatctatctaatgctggaatttttgacaacatattttcatattttgtggcaacctctggattactcatcatcctatttaaaatctcaggagcaatcctcacatccgtttttcctgtacgattagctgtttttacatttttatccgaacttcctgccacaatatctatttgaggatttttttcctgcaatttttttacataatcttcctgactctcttctgttttgcccaccagtgaattttcctttgttttttgaatatcacaagctgcctttttaaccgtgttcttgtaccctgatgcataatacgatgtgtaactgctgttatcgatacctgtaattgccataatcctacctccctgttattgaaacttaaaataatttctattatattgaacgacttggatatttaatttccgttgatgtaaattcatcttctgccgaaacattgatatgcccactgctgtcaatggcatactctttaccataaacggaaaacgtatctccttctttatatccgatttctatccagtttatatcatttaactgttttatctttgcgtcaacatttatggtctttcctgattcctgcaataaataagtgtgttttcctgctcccgcatctatagaaaagaatcccggagaaatcccgactttctcacagacggacaatacctcctcattgctgtagagatacccccacacactctttccctgtgccagatcagacaggatattgcctgccttacacatttcccacttataatttgttcctttttgatttgtattctctgcaagcaacgattccgaggctgcccagcctatccttccattattgaccgtccatgtatatttaccgccacttgatgttgtccatgcataataacttttattacttagtaccagagaattattcgcagcacaaatgcctgacatggtgcttgtattcattttcggtactgcataattaggtactacctgtctgctcccattaaggtcaaaggaaataaccccatactccttaaaatcagaattatatccacaggaaacattctccccaaaattgattgcatccaaaatagcacttgaattattatagtttgcaaaataataagccaattcactgttagaaatattcgcatttttatctatcagtgcagctatggattgctttgaaaagcctcgtgcagcatcagaaatacttaaactgtcctgttttttattatttcctgctccaagcaacatctgtattgctttttggtgtattcctgcctctgcctgctttgaatatgtcaacagctggtttactgtgtttacatctgtcactgtcttcataattattctccaaaccctttttcaacattaaatgccaaacatatgttgtaatttgtccagcatattatttactctgccttcaacagcatctggctgattccttaattcatacctgcttccatagtaatcatttaaacggtctttcatctcattacaaaataatttttgatctgttttaccatttaaaaactgattgcagataccacttatctctttcttctcatttgtataaaaagctgtctcatctgagattatttctgacttgtacttataagattctgttttgcttccaattccaacaaccatgtaatctggtgtcattttctccatgatagaattacgtgccgaatcattaaaatgaacatattcgtcaatcatgtctgaaaaaccagcttgaaattgctctggaacatacatttcatttactttccttagccccacttcacttgcacttaacaaaaatacagattcataagaagttcctctatatccctcctgagcattcaaagaatctacatctgctgtcattgcattaatcttctcttttaaatctttcatttcatcttctgtcaaatattcagaagcattttcgtccagccatttttcaaaaacctctgattgattttccgaacagccttcaaacgcattttgttctccagaaatggaagttgctttcaaatctaatttgaataaattttcacatttatattctgctggtatctctcttatctctccattaatagatgaaaaatgcattgtatgaaaatccgataccttattacgagcagtctcaactaactttcttgctgaatcactgattttcacatcatcctccgaaataatattctgaggaacagttgttttcttctcaaccttattttttatcatctctggattattaatatacctatttccttgaactttcatagcaacctccctaagttagtccacactttctatacttctttatctatcttactcgatgtcaaagaacctgcatctattttcaggtaatctacatcactgtcattgctcaatgaaccaataaaacgatttatatctactgactttctgccactctactctctggtgatgccatactatgcaccaattagatatttttcttttatcaaatcctcttatgccttaatatcaaaacttgatctatcaggtacagaaatactcacagatcctgctacaaggctttgtgtcatactttttacatcagtaccagttacggataaggtataatcacccgtttcctttctttctgccgatttttctgcacgtttctttgcagctttttcttcctctgcttttttagcagctcttttttcttttatcttttcctctttttctctgttctcttttgcctttcgttcagcattctctttcgctattttcccatctggatcatttgtacaagatgctgtctctataatatttccgtttgcatcaatcatataactctgatttgtcacagtgcccaaacatccattaatcgtatcttttgtacaatccggaatggctgctaagttttcctccaaatactttgctttttccggatcattcatgcacttttgtaaaaatgcacttgaaacagataccgttgtcggaataccctgcattgaagtcagccctatattcatataatggtattttccttgcaagtattttgaataatcatttacattactataccctgtcttaatctgctctgtttttgtcacaccgggacgtgatgtttttaattcaactgtacttgttgtcacgttgccatcttttgtatttgtactatccttttcactatctgttttttttacagtattcttataatttgaagcataatacgatgtgtaactgctgttattgatacccgtaattgccataatcctacctccctgttattgaaacttaaaataatttctattatattgaacgacttggatatttaatttctctcagcctcaatatgatatgtaattactatttttatttgtaaatcatagtactaacatcatcaaatcttaatgctcatcaataactgctctctattaggctgaatcattgtatatttctccttaaatgaggtaattgcaccatacattttctcagttaaattttctgggatttcgtcctttcccctggttttttgctcctcaatgtaagccgatgccaaagttgaccttgtggtaatttttgaaattttattcatttcttcaccaataattccacgggcatgctgattggttgtctccattgtcacaaagtcatccactgtttttttatatgcagcatctaaattgcttaactcttcatcctttgtaagcttacgaggtccattttcatcagctacatatatttctctggttccattttcatagcccttcacaatttcatcatataattctgcgtatgctttaacataattatttgccttgtcagtaatatttaaggcactttttcctgtatcaacattttgattctgctgtgctgccttcttttgaatttcataactataatcaatatcactgatttttttactcgctaacagttcctttctttgaaccacatcatcatatttttcctgtccactctgctgtatacgattacgataatactccaatccctcattagaaatcgaaagcttcactgattgccccactgtatgtttttcgtttgtctgactatttcctttctgtactttatcagtatttttttccattattgaattcgtattattcatgtaattagatattttcatattgtcacctctttcaattattcaaatatccctgatccagttcttctttcgaccagactctttcatacgttccaccaatttcgtcaaaaaccttttgccatgtagaaaatttatggatttcctccatgctatccttgttattctgaagccattcatacagcttttcatacatagaaccagaaaaccggacactccaattgtttttataattttcattgtcactgtatgacattccatcagctcctatggatataattccctgatctgtccgttttgccattcctctaatctctaaatcagcccagataaaaccttcttcccgactctcaattaaattagggtatttgtcaaaatacatctccgctaattcttcatacctcttccgatccgcttcattttgcagaagaaccttgccacctctgccttcctcaccgtcttttactaaatactggatgccggtatctgaatgtgtatttaatgtaaatccctgcaaagtctccacatccagcgaatctttatccattacattctgcaatgcatcttttaattcatcatctaataccagggcatcgtaactcatcgttccatgctcagaaatcaaaaactgctttcctgttgtttcatcctgtcttatttttatatcagaataggaaaatgcccccaaacgctccccgtctttattgtatatatcaaaacattcagcttcattatcgggtacgattctataattttcggattcgtactctgaatattcctgtttcaaagtatttatcgtttttcctgacagtgccagataagaatccatcactgtacttttcttagcacgattgatatccgctctactgctaatatcctccttatccaccgtctgagccaaagtgtcagcccacttattctggttccgatttggttttaggttgttataacctgttgaataacggctctccgctcctatacttccaatcattttttaaattcctcccggcattttattctcttattttagatgccagtacggtataaaattctttttcctgctgcagatatgctgccctttcctctgtaactgctgccaacggattttctattctctccaatactttgtcgatagctgctaaacaactttctttcgtttcaccaaaaatattgtcatcaccacctgtcagaaaatcctgctctaccgatagctgcgttaatatactggttacatccgtctgaaatggattaaaaccagtttcttccaatgtttcctgccatgctgccttgacactctgcggcactgtctgaaggtaataaccactcatataagcaatctgctttttggttttttcgtctgcaaactgataggttctgttattcactttttttgtactttttcctttcgatggaatataagaccagtttggttctccattactaccagaagtaattagctgttcccttccaactgttcctatatttgaaaaagagatccccattaatcacactctagcttcaaacatactttggctaacacctttcatccacatattctgtgctgctccatatcctttttcctgccctatatcatacaatccactgctgtcaaagcctatttttaataccaaatcattttctttcttccagccatttttagcatattgcagccatctcttagaataaagttcataccctgcaccatttttagatttttccttaaacaatgcaagtaaatctgtaccatcctctgcaataaaagtaccatttttatatgtcgcattgcgtgcatcatacccggttgtctcatacacttcatgccataaagaatattggtttgcctttgtcatatttgcctgcgaattaacaatttcattatctgcatcatgcatacaaatccacgcatgcgtccaaatattttttgcattatctccttcattcagcaatttttctatctgcaataatatatctctatctgcatttcccgacaccgttagttgatatgtatatgggtcaatagaaaataccaaatctgcctgttttgatattgatatcccattctttgaaagtagatttgaaatttgctgatttacaacacttctggcatactgtttttccctgtcagtattgcgtacataaccaacacttcttgaaccacctgtatatacatccttgtaattccttaatgcataatcataccgggcaaatccagccgaatattttcctcctgtttgtaacattcttttctcattgcggtaagctatggaacgctgatcttctgtcatatatgagcaaaaattaggtgaggtcacatcacaatattttgattcgatatatgccattggatcagaatgagacaaattttctttgtacactttatcataatgctcctgcaaaactttttgtacgaaacgatcctcctctgtaagtccatcatattgatatcctacagttgtatcagcgctggaagtattgggcaggttgtttaaatccctgcccgctggaatgttattataatagtcagaattatttacagtaaccatattatccccctgccttatataagtcttataatctgtatctttaaattcctcccggcattttattctcttattttagatgccagtacggtataaaattctttttcctgctgcagatatgctgccctttcctctgtaactgctgccaacggattttctattctctccaatactttgtcgatagctgctaaacaactttctttcgtttcaccaaaaatattgtcatcaccacctgtcagaaaatcctgctctacagataactgcgttaatgtactggttacatccgtctgaaatggattaaaaccagtttcttccaatgtttcctgccacgccgcctttacactctccggcactgtctgaaggtaataatcactaatatatgcaatctgctttttggtcttttcatctgcaaactgataggttctgttattcgcttttaactgttcatatgccgcctgcgcctcactattcgcttctgactcataccagccatctttatttttgctatatttcataccattgaccgtaaaatctttggaagtgtctatacccagataagacataacatccgtaattccttctgtataccgggcatattcctcctttgaatgtgctacagtagtcattgtcccacctgcatttcgcagcatggatgccaatgcatctgccattctctgtgcttttacatatgattgtgtatcatacggattatctccaccagaaacctctactccatgcgccgtagccgtaatcacatgacctccattaacacggattctttgcccttccgcaatattaacagaattattctgtctgctaagtgacgaactcttcgccaattttataggtgtttttaacacttgaaccaaatcttctaccggatttagtaagtgctgcgacatcgcctcattataggtttccttatctttaatagctgtatttttgtaattagatgtaagtcctcttgtattaggattaatataacttgatattgactgcattgtctcaatctccttcgtttattctaaattctcttttccttctatgtccaaataactaagccttatttatacttactatttgtatttggcaaatcaagataagcatccatacttttcgtccaaagcaacgataagtcaaaccttcccaatttgtttaaatcttctatgctttttttgaacattgagataaaatctcttctgtcgttaagtcccatattaccagcttcaagtggcagagacgtgaaacctccctgcttttccactttgtaatgtgcctccaatgcacgcatttcgactactgtagcatttgatggattaacatcattgatataaattctttgctcaaactctttcccgttttcatccacacctttcgctaacaccacaggattttcatccgtcgaatcatccgcatatttaagacaataagaaagacctgtaccattacctcctgtccacaacatattatctgttgtaaatatctgatataccttcggtgtttctgccgtataaaatgtcttttccccagatgcaggagttttcatttgattacctttttgttgaccatatgatgaagatacggtattcaggctagaactaatgttcatatttttgtttctccaatcagctcaaaattttctctttttaattattcaaatatacctgatatgttaaattttagtatcaagcgttgcctgtgcaggagatttccccgactctgccaattctcttgtaacactatctaatgcaccatctttgattggcttaccaattttccagttaggatcagccttttttgcggcatcataaaatgcctgtctgtaaattctctcatatttttcaagcgtatacccggcagcttttaactgggactgaacagaactgctgttcaactgagacaactgaaaactgcctattacattttctcctgatgtcccgaatgttttttgaaataaaaaagcataatctgtaatctttgacataaaacatcctcccatctctattccaaaaaattataacttttccaatgttaataatctgctcagtttctctatttcctttatcggataaaataacctgttctcttagccccatctcatcaaacgaccatattacgcacacaaagaccatacattgcataaataaaatatataccacctgccatcggtagtttctctggatgaatgacgaaaaaatcagcgggcatattacccgctgattgaatgtaaaatggaataacataattatgaaattatcttgcggtaatacagataagaatagattaccggtaaaatgcaagggacgagaataagtgcaataagtatccacatattttggaatggtgctgtaacaatcatgataatcccaccgatcaccatgcattttcctccaaaccgatgcgtgcgataccagttttccggatcgcataatgcccacgaaatccgaaatccaatcgtatagtttggctttactttcggtataaaatttcccaaaatcagataaaaaactccgatcatcagaccacacaggaatcccatatccaactgaaatcctaaattatatccatagagtacattacaaatgaaaagcgataacaatggaataatccataagataacaaagtatactttttcactgatattttttactttaggatcaatattcattgcaatcacactcactgcatgtcccaataacataatgagcggaagtccaaacacagcgaatgttttggatgcatacccatttggttcattatttattccccaatgtgttgccagcgaatccggtaattgattccacaatagcaagccgataaaaatcggaaacagcgttataattgatgtgagtaaaatcatttttttatgttgtctgatcatagtcatcttctccttttaattcactaatccataaaataatctcctcaagcacagatgcattgagctcataatagataaattttccctcacgttcatcacgaatcagatcagcatcctttaaaacggacaggtgtcgggaaactgctgcatctgaaatcgaaaaatgattgcaaatctcgccagccgacaaccttgaatgtttgagcagattaagtatttcgcgccttgtaggatcggcaagcgcacgaagcgtgtcttgcattcccaagtccattccctccttcatttaacatttaacttaattgttaaatatattataacacaatcttttcatttttcaagaaattttctatcctatgaatgttgaatgtctgtctgatgatgtcttttctgtgtctgtatataatgctatcccgcagtttctgtcccgaaacacttgtctataatataaactttccttactttattttaatttttatttaaaagtcattcccgttttgctttaagaaaacaatatatcaagtaagcgattgctaggatgatattgatacaaaaaacaactcccatataaacaagaggactttcaaaaatataatccatgtgattggtatgatatccgtttccagaactaaatccggttattgagtcaatatattgaacaataattgaaaggaacggaagtgtacttaaaccccatatactaaaaattattgtttttatagcaaaaattttccatgaaaaatctttcattaaagtcacctcccatattaaacctgttatcttacctatatccttacgctttcctatcaaaagacgttttctcttccaaatagttcggcagttctttcaattctgagctttgggcattcttttgcgtatggtattcattgaagtaaattccgtaaaattctctttccttttcccgctcagccggagttctttcacatccccatccgtaaccatctcctagataggtcagcacttttgttccttgataagaaatgtcggcaccatatccttcgcctgtcagaatcggacattccagtgtgcctcctcccgccagagcaaacttcttttgcgcaaggttgttatttttcccccctgccctctccagaaaatcgagcaatgataattctccgattcctttgcatttcggattaccattttgactttttaccgcatttttagcctgctgatataatgcctttctgtcaggggatacatcggatatgtattctgcacataaccttgttctctgcctgtgaatagattctaattccgttttactcgtagtgttggcagctctctgagccagttccttaatctcagagacaaactctgcctgtgacttactgcttttccctgcacttggaatcatagaccaatcaggttctccacttctcagcgattcactatattttgtaatggcagaactcgttgcatttgaaatcgatattcccatgaattcacctcatattttctaccttctctgcatatattttaacctctatatatacttatccatttatcatattcattctttaaaattctcataacatacttatttcctctatttttttatcggataaaataacctgttctcctagtcccatatcatcaaacgaccatattacgcacacaaagaccatctctttacaagatgaccactgccttaaattcattttcatcgcaggaaagcaccatatcaccgccatatttatccacaactgcttttacatttaacagcccaatgccgtgatgatcccctcttttgctctttatcgtgtcattttcaatttccaccttttctgtcaccggatttctcaccgcaaatatcagtttatgatcttcgcactctaatttcagatgaatgaccgcttttccggtatttttcagtaccttttcactctcccggattgcattatccaataaattagagagcagaatcacaatctcttcctcctccagacagatctcctgcagatcccctactttcaggataaccgctatgtgtttctcctgcatgctgcggtacttctggtttaaaacagcattgaccaccggatggttcgtgttgattgccgacatctcgacagctatgctctctgtcagcttctgcgtaaaggaaagtgcctcatctgtgtgtccattctttatcaatgtctggatcgtggaaagctgatttttataatcgtgcatttttcttcgctgacgctcatagatttcttcccggtcctgataatctgcaatacgatttttctgattttgttccgtaagtaccgcaatttttattctctcttctcctttatacagcatatattccctcttcacctgtgcatatcgtgccttgggaaccggaatcttttttcccgtggtaagtgtcatcacataaccgctgatttttgtgatgtacctcatatttacaagaaaacttaaatgcgcccgcacaaatcccatattctttaattcgttttccagttcatccagttttttataaatctgaaacgtacctttttcagtataaaatacatttttgtgaagttctgtttctatataaatgatgtcatctgcataaagttttatcgttccctccacaaaacgaaattcgagaatcctacggtttttattaatttctgctatcaaatcatccatacattcttctatagtatctgcaaggttatctttcagcagaaaacggcttgctttcaccttatatccatccagtgcgtaattcatgtatgccgtcacaagtacaaccagaagttttgggtatttttctttaatcctcatagctgttttcagcccatccatcccctgcatattgatgtccagaaataatagctgacacgcttccaaagccgattgttcttcgcataactgttctccggattcatatgctgtaatagcaaactcataattctttttttcaccatagtctgacagcaaatctgacaaattttttctgtcatctatcctgtcatcacaaataataatgttcatatttttcattcctgtctttgattgctctcatacctgtaaaccatacaagtctcacctagcactctttattatatcaaacaaatctttcactcgatcattctctgcatcaaatgactattttgcgcatagaacgactatctcctatagaaacgcagaagcactgtatctcaaactctttgaaatacaatgcttccctgcattttctatatcgtcatgttgatattattactttactattcccagaatatttgcagcttccttaaatgaataagatttttcccttagttctttttccggcactgacatggtgcgacgaaggacctgttcctgctcagcctgatgctgttcaatctgcgtcctgattttctgtatatcattcatagcatccatccgcatgcctccttccgctcacaatataacacgcaagagtcggtgtcataactcttcctacattcagtgtctgtccatacagggtagaaaataacctggttgccctccaggtatccgtcctctctcttatctgcaccgattacctttgcgatggactgcgccaccgaagttttctcggcaattactaattttatatttttttcactcaaattttgtttccttctttcattttttatttgctttttgatagcataaatgctatcatgtatatagaataaatatttccacttggagaacatatactaatgtacaacattgaattttacgaagattccaatggcagatcagagctttgggaatttcttgaatctcttcgagtcaaagcagctacaaacaaagatgcccgtattcaatacaagcagataagtttgtacatccagctcctcgaagataatggtacacggcttaatgaaaatatcacaaaacaccttgatgatgatatctgggagcttcgcccaggcaataaccgtgttttatatttttatttccaaaatgatacctttgtgcttttgcatcaatttcgcaagaaaactcaaaaaactcccaagcgcgaaattgaacgggcaaaggctgaacgtgatgattaccttgcccgaaaggaggctgaatgattatgaaaacctggaatgactataaggaacatgtaagaaccgttgatcctgaaattggaaaagacatagatgaagttgaaaatatttcctccatcgtaagtgccatggtggaacagcgtacatctcttggacttagccagagagagcttgctgctatgtgtggtattccacaatcatccgtagcacggatcgaatcctgcaaaacaaccccgaatctcggaacactgcttaatatttttcagcatctcggtttacagcttacagtaagacctacaaaacctaccgtttaaaatcaaggagaatctctgcgaagaggttctccttatcggaatctcaccgaatcatgcctaacggctcgtgggctataccaccagtagggaatctgaccctgccctgaagatttctattcacttttcttacgtagctgtgttgtagcacaagcattcatgtaatgcaacagacaatttcgttgctgtatggctacctaaaatgaattttaaacaataaaaacaagacctcccattacacttttcagtatctgagaggtctgtatttataaaaagtttaatcgactgacagtccaatttcatttaacgccaaaatgttttcttttacacatagaattttttatttgctgtatattctcgcctcatatggttgcaaccattcggactccgtttcatgataattgcacaatacacatttttgatcaatttttcgaaacatcagcttttcatttgtaaaattcacgatcaccaataaacctttaccgtctacttctctttcatatgcaaataatcccggatattcttcgtacatcgggcgaaactccgcctgtctcacaatatctgcatggtcatggtaacactgaatcaaacgcttataataattgtacaatgaatccggatcattcacctcactctgtacattgattgttctataattatcattgcatttaatccatggctttccacacgtaaatcctccattttccgagtcatcccactgcatcggcgttcttgcattatctcttcctaactctgaaaagtatgcaagtacttcatccggatccttgccttgtccgaccgcttcctcataggttcttttcgcccttatatcatccatatcattaatattcttccacttaacattggtcataccaatttcctgtccctgatatataaaaggcgttccatataaaaagaaatagatactcgccagtgccgatgcactatagaaactaatattttctctttccagaaatttgttcaggcatctggactgatcatgattttctaaaaagatagcactccaaccgattccgctattatgcgctacatgtgtaaacatttttttcttccaccgttctaccgcatgaatgcttgatttatcattttccccttccatattttcccatccaaaatcgaaaatcatggaaaagtaaccattctttccggcataccgttcaaaagcagcatcgtcaactccaggtgcttcggcaactgtcatacagttatatttatcaaagcactgctctttcatctcatcaaggaatgttccgattcccttataatccgtaagtttttcaaccggatatcgttccccatcatttgtaggacgactggcaaaacttaagtcttttttgataaaggtaattgcatcgatacgaaaaccggcgattcctttttccaaccaccagtttatcatctcataaattttttgacgcagctctttgcattcccagttcagatccggctgttccttcgcaaacgtatgataataccatctgccatctggtaatctcgaccatacggatccgccaaaattggatcgccagttattcggttctttatcattctccgttgttcggaagtaaaaataagacgcttcctcacaattaggatccttcattgccttctggaaccattcatgctgatccgagcaatgattgaccaccagatccaatatgattttaatctttcttttttgagcctcctctattaaatgctccatatcctcgtttgttccaaagattggatttaccttgtaataatccgatatatcatatccattatccacaagtggagaagcgtacatcgggcatatccataatacatctacgcctagattttggagataatcaagcttctggataattccgttaaaatctccgattccatctccgttgctatccataaaactttgcggataaatctgatacactacggactctttccaccaattgtttttcattcacaaattcctcaccttactttattgccccttctgtaataccttttacaatgtatttttgactaaacaaataaaagataataataggagccatgcacataaccaatccggcagaagccaaatcccaacgttttgcaaattgtccaaagaacaaatatgtttttaaaggcaacgtctgtaagccctgtttattaataatcagcgatggtaataagaagtcattccatgttcccataacattaataactgcaaccgtgactataatcgttctcatcaaaggaagcacgattgaaataaacagacgtattgaaccacacccgtcaattgtagcggcttcctccaattcctccggaatattttttatgaacccatgaaacattatgattgccatacttgtttgaaagcccatatacataaagatcaagccaccacgagacagcaaaccgattttgcttgcaaatccaaccaatggaagcatgacacactgaaatggaatcaacatagaaccggcaaatatcaaaaaaataatcttacttgctttggttttataacgtacaagtacccaagccgccatagccgatatcaacagcaccagaaccgctgtcactaccgtgataagcagcgaattcataaaagatcttatgtaatccagttcttgaaacgcattcttatagttttcaagtgtgaatgttcctttcgccggaaatcccaacacatctgtaaaaatccccttggtcgtcttgaacgaattcataatcaaaatataaatcggaaacaaaaaaatgcatccaagaataagtcctgttactccataagcgatttttttcttcattacatttcaacctccttgcgctttgttataaccaactgcgtaactccgattcctgccacaataatcagaaaaacgattgcctttgcctgtgcaaaaccaaattcatttgctccaaaggcagaattgtaaatgtttaacgcaatcatttctgttgatttgtatggtccaccttgtgtcaaagctaaattttgatcaaacattttaaatgaactcgaaatagataagaataatccgattgtaaacgcaggcatcatcaacggaaggatgatatatctcataagctgccatgagtttgctccatcaattcttgctgcctccttaaccgattccggtatctgctgaatctgcgcaatatatacgatcatcatatatcccgacatctgccacacagtcaaaatcaacaatcctataaatccggtttccggattcgacagccatccgctaaaggctgcaattcctgtcttttttgaaaaagcttcaaaaatcgatataaaaataaactgccaagtaaatccaagcaataatccgcctatcatatttggcataaagaaaattccacgtaacagcgttgcgcctctaaatttctgtgtcactaacaacgccagagcaaagccaacaaagtttaccaatacaactgcgcacaccgaaaaaagcgcagtaaataaaaaagcatgtacaaatgagtcatctctcgtaaaaatgtcaataaaattttgaaaacctacaaacttaatgtccgagcctacaattccattccagtttgtaagggaatagaaaaatccaatacatgcaggtatgattacaacaatacaaaatgcaattaatgacggtgccaaaaagccccaaaaccgtaatttactttttctcatacttcttctatccgtcctttccaaacaaaggattttacccttatttgaatttccgggatagaagctctatcccggaaccctctttaactcttactagttgttctgttgttttcttaactcactccactgctcgatacaggtctttgtaacctcatcccaatcagcttctccggcaagatatttctgtacttctacaccagccacctgctgaccccatgtatttggagctccactgtatacccatccgttcatggtatttccggaattatttgcatccataattctctgtgaaagtggatcggatgcttttattccatcaaaattatcatatggaggaataaacttacaatcattcacaacaattttctgtgcttccgaatcggtgaacatccaattgatgaagtcttttgcagcagctttctgcgcatcggttgccttgctatgaattgcccaatatcctgatacacctacaaaatacttgccatctgaatatcccggaacagaatatggtaacatatccaatttttgaaggactgccggatctgttgtctctactgctggagctacccagtttccctgcttgatacatgcaacacgttcaatggcaagtccaccctctaatgatgttgtgtagtctacagaattaagatttgccgtattgttggcattggttgtataactggcctgaaaatcaaccattttcttatagtcttcaaagccggttcccggaagcgaatctgccgcatatgcttcattcggagtcttaaagtcatgtgttaaagcaacattagcgtcatggtctcctgcaatccataactcctttgtcgggtattccataacagcttccagattcggatatttatccttcatctcaccattatcgattttctttttcaaagtatcaaaaccggccttcatgccttcgaaattcatcatagaatctacagaaactccagcatcctcaaacatctgcttattaataacgaatccataaccttccatgtataacggaatggcatatacttttccgtcttttgtaaaagtatccgttgttccttctaatgcgtgctgcataatatccagatcagaaacatcttcaataacatctccgtaatctttcatgtccgaaaaaccacctacagaaaagattgttggtggatccgactgcatctttgctttcattgatgcgccaaaatcatttcctgtgacagcttcaagattaatttctacatttggatgatccttttcatatgctgcaattaatttcttgtatccttcatttgcctcaatcttactctggaaaattgtaatctttacattttttccactgtttgctcctgtcgaggtatctgcagaatttccgcatcccacaaataatcccccaagcattagcactgtcattccaactgctactaacttctttgctttcatatatattcctcctttttgtgaaactgttccatatctgatcaaaaaaaatttttcatctatggatgcctcgttttgtgccacggaactgtccacatcatttgtggaactgttccatatctgtaatatacactatgcgtaactatattgcaacataaaaatgcagtttattcacagattcgttactatatccaaaaatcatcttgattttttattaaaaatcactagaaaaaggagactatgaagaaaagtctgtaaataataatcttctatgataatgaatgagctggaagcctcttcttgccataataaaaggcctcctatgatttatattttaccatagaagaccttgctgttattagctatttacagaaaaagtttcacacactcctttgtgccaatgctctccattctacaaagtatcgccctttttatattttacaggaaccaatacttcccttttcttaagcggttgatcattgatcagtttaataagcatattcacactttcctttgcaaccttcttcgcatcctgtacaattgaatcaatcgaatggtaattgaagtccgtggcataagttccatcataagccaatatttttttgtttttttctgtcttgaggaaggcggctgcacacaagtccaaagccataattccatcaacgtccggatattgatccaacaatgttctggtacgtttcatacacaattgatagtttataacttcctcccattgaaaagattcaatgataacctccctattatgcttctccatcacatcgataagggctctcgcgctatcggcagaggcaagttccatcctggtcggatcactaaagcacatcacttttttacagcctttttccaaaaacaattcgcccgctaaaattcctccctgatgatgatccgatgtcaccagcgggattcccggtataatccgatccagtgagataattggtttctcaatattcatataatattcatcagaaagaaacgcagatcctacaatcagtccatcgaacagattacgttccaatgtatcaagatattctctttccttgtcctgatttcctctggtattacaaataaccacattatatccgtattgatctaattctgcctcaagataattccaaagagttgaaaaatacggatggataatatccggtgtcataacaccgataatacccgttcttttcttatacagatttctgatccactgattaggaatataatctagctcctctaccgccttcttaattttgtttttgcttttctctgatacatatccgctaccatttaacgctctggataccgtgctgggtgctacatgtgccagctttgcaacttctcgaatgcttgccataatctcttctcctcacttgtgtaattgcaaacgaattgcccttatattcccctttatcctcttaattaaatccgacaaccttctgcgacaatcgataagtcgcaaccgaaatcttgcggcctcccttaccctgaagattcatggtctgtcccataatgccattgcgtagttgctggaagattataatatctttttccttaatatactgaagttttattttattatacacctttttgtccatggagtcgaactatttttacttaacagtcagcagttatactctttgtattttcgtataataatcatataacttataaacaataaaacagctgcgctggtccaggcacaaatttccgcataaaaaattccgtcttcaccgatcagttttggtaacaataatgcaacactgacacgcatcgcaaattctgcaatgccactggcgaggggaatcagggtattacccagaccctgaatcgccgaacgatatacatacagcagatacagtacccatagaaaaattgccataataaacaaatatttatatgcaatgtctaacacctgtcggatctgttcctgttcgccggatacaaacagtgacaatatattgcgtccgaataacaccatcacacctgagatcacaacagcagtaagcaatgccatataagttccgctatgcacacctttccggattctctgatatttctttgcaccaagattctggcctacataggttgtaattgcatatccgtatgaaacggcagccatctctaaaactccatataatttgtttgatgctgtaaatccagccacaaacaggaatccaaatccattgactacatactgtactgtaagcccccctacagagatgatcaaattctggattgcaagaggagtcgccactttcaaaagccgcagactcattgccggctgtctgtagaagtcctgtttttccagtcggatatccggaattttccgtaacaccatcagacagtacagggctgaaaatccctgtgcgatgactgtcgccactgctgctccggctacaccccagccaaaaactgccacaaataacaggtccagtcccacattgatcaacgctgctacggtcattgctatcagtggagatctgctgttacccagtgctcgaagaatcgctgcaaatatattataagccgctatgatcggaattccggcaaagatcagccgaagatatagcattgtcaggtcaatgacattatccggtgtctgtaaaaacaaaagaacatgataaactgccccttcacttaccgcaagtacaatcacagaaagcagtgctgtcatgatatagcttttcgccaccgcgcatttcagattttctttttcccttgctccataaaactgagctaccagaatagaaaaaccctgtgtgatacctgtcatgataccgaacactagccataccagccagtctccggcgcctactgccgccagtgcttcaacccctaccacctgtccgacgatcatggtatctgccatcgtataaaactgctgaaagatatttccaagcatcagtggtatggcaaaagtaatgatcagttttccaggtgatccagtggtcatatttttttcatttgttaccataagaatctcctttttcttttcatccttgtccgattatttcacattggactctgtcaaaacgcaatccatcacagaactctttggtatatcgtcccaccagtgtttacgaactctgataagggcaaaaacaagaccaagaaaattatataaaacagtataacacaaaataaaagtgacatggtgaactgattgaaatgcttctgatttttgcaacaaatgattgatttaacgataaggaaatttgatacgatgagaacaatatttgcagaatacaatcccaagcgcaacagtattgatgtttacacctctattggctatatgctccgcattgactgttgggaagctgaaaaggacttaaaaaccacaccaggatcagactgtgcattaaacccactcgccattgatgaacctcttgaatatgcaagattatatcttgatggaaacttgcttgatgtatcggttagtcaaagtgtctatatcagaaccttttatcgttccttgatatagacactttttttaatagtcattcaattaactaattgatattttcgccgtttgttgaaataacttctttataccactcgaaagaatctttctttcttctggacaagtctcctgttccatcgttatgtttatccacatagatgaatccatatctcttatccatctcaccggttcctgcactgacaaggtcgatgcatccccatggtgtataacccatcaaatctacaccatcttcctctaccgcctttttcatttctgaaatgtggtgctgcagatattccacacggtatggatcgtgaatgcttccatccgcttctaacgtatcatatgctccaaatccattttctacaataaacaatggtactttgtagcgatctgtaaaccagttcaatgaatagcgcagtccgatcggatcaatctgccatccccattcacttgcctttacgtactgattctttatgcgatccttttctccacggtaatcatattccggattgtctggttctgcttttgtacagaaagacatataataactgaaaccgatgtaatcgacacagccctgttttaacactgcaagatcttcttctgttacgtcaatcttaaggtcttttctttcccagtatttcaaaatatttacagggtattccccttttacatgcacatctgtataataatatcttttctgcatggctttttcagcctgcagtatatcttccggacggcaggtagccggatagattgggcacattgcgatcatgcagccaatctgaaatttcggattaatctcatgtccagcttttatcgcttcggcactggcaaccagttcatagtgagatgcctgatacatcaattcttccgcattttcttctggtttaattataatcccggaattagcataaagcataaatccatcaccgatatctgcctggttgttaatctcattaaatgtcatccaatattttactttgtctttgtatcgctcaaagcatgttactgcaaatttcacgaagaaatcaatcagttttctgtttctccatccaccgtactcttgtacaagatgcagaggcatctcaaaatgactcagtgtgatcactggttcgatcccatatttcagacattcatcaaacatgtcatcatagaattttaatccggcttcattcggctgttcttcatcaccatttgggaagatacgtgtccatgcgatacttgtacggaaacacttgaatcccatttccgcaaataagcggatatcttctttatagtaatcataaaaatcgattgcttcatgattcggataattctcgccttttagtatttcacctgttattcttcttcttgtatttacatctccgccggttacaacgtccataatgctcaagccttttccatctcgatcataggcaccctccagctgatgggcagcaactgcgccaccccagagaaaatcttttcgaaatcccattgttatttccttcctgttgtcttaattactttgtataatagcgttgggggcttttgcccccaacttttctgtttctatattcaattacatcttgatgattatttctcatcaattctcttatacagtgtaatgaattcatctgcaagaatgcggaatgcttctgcactcataagctgatcttctgcatgcatcagaagcatgtatccattggaaatttcaccatttgcatccattgccaaaagatctgcatgaacgttgtgtccaagtgaaaaggcttcatctccttgtttaatcagctctgctgcctcatcatattttccttctttcgcacaatggatcgcattgataaaatgtgttcttgctgtacctacatatgtgatgatctgaaaacatgacaattcaaatttttcgttcatttttttctcctatcctgctattatttttattctgattttaccagtcttcatcctcatcttctaccggctgattcttctcctgaaccagattcatcttgtcaaccttcttaatgaatggcagataaacgaagaatgaaacacaaaggatcactaactgaagtaaagcacttttccatcctgctaaaaggaatcctgagataatcggtggacaagtccatgggatctgtgttgctccatataatgggcagattcctgtatacagtgcaaaatactggattaaacatgcgatcacaggcattccaataaacggaattgcaagcattggattcataacgactggagcaccaaacagaattggctcattgattccaaataatgccggaataattcccaatttaccaagtgctttcaactgttttgattttgcaaagaagaacatatacattacaagtccgattgtgatacctgcacctgttatattgataaactgatcataaaactgctgtgttacaatatggcctccgtttgctattgtaagttctacaccactgtcaataatagcctgatttgcaaggctgtttgcctgtaatagtcctgtcatgattccaccaactactgttgaaccatgaactccgaagaaccacaggaatggtcctgtaaagcacatcagaactgctccaccaagggagtctgtcattttctgaagtggtgtctgaacaactttgtaaataatttccatacctgttgtgttgaatccaatagaacagataccgtgaattactgcagcccctgtcaggattacgaatgccgggattaatgctgagaatgcatttgttacaccttccggaactccggccggcattttaatacgtatatttttctttaagaaccaacagtaaataggcggtacgatcaatccgacaatgattgctccaatcattccctgtcctgctgtccatgtcttattaataattccactaacaacttctccaccttctgttgttatggacgaaggcatcagaatcaagaatgttgccagtgaaataattccacagttgagtggttcctgattttccagtttcgcatagctatagctgataccgataactgcaatcaacgcactgatggagaatgttgcgccacatacctgatctaatactggtttgattcctgtagactctaatacatcgacaactgcctttaccggaaagtttgacaggatcaggaagattgatccgatgatcagaggagacatggaagtcaccataccattttttattgactgtattgcctttgtattaataaacttaaggattacagggattactttttcgttaaatttctctttcatttgctactaccctttgctctgttttttgctttaaattgtgtatctttgttttctcttatttatttttcgcaagcttatatgcaaatttcaaaacattcattccattgcacattccataatcctgcattgggatcacatctaccggaaccccttttggatcacagatctcttttgctctggcaagctgatatcctacctgtggtccgagcagtgctacatccacgccttcaatcacgcgttccatctctgtaaatggatatgctacgatatcaacatcttttcctttttcctttgctgcctcttccatcttctttacgagaagactggttgacattcctgctgcacaaaataatcgaattaccatgattgtttcctcccttatttttttctcatttgctttgatggtgctagtataacaagtatttttcgttttgtcagtactttttcctgtttctggtttctgttccatatagacggaatttgttacataaaaaaaacagggcattctactttattgtgtaaaatgcactgttttccttttccttttttgtatattatgatactttttagtgtattctgttttttttgttacttgtctggttactattcgtaccattacattctacaaccttaatgaaataagtcttccatatcattttaaaacagatcatctgtatcgttatggacgcccttcaattctcttccgattaattccaaaataaaaacgactgccacctgggatgtcagatcataatcttcgtcttgtttatatttatactctgaaacataataatttatattgcagtcactcatcttcgccaaagaacagtttgccttatttgtaatagatatcaggctgctccctcttcttttcaacttttctgccaacatcagtgtctgttccgtctctcctgatacagacaatgcgattgtagctattctctcaccttttccacgaaataccggcgtgaacggatcatcaatagcaaatgaaaaccagcctacattattaaaatatcttgccccatactttcctataaaagaagaattccccacacctacaaatataattgacgatgcctttgtaagtaacttcacagcttcctggatattctcagcaaatgcctgtgtctgcacccgttcaaagaaatctttaaccgcagtaagatccatattgattttcttcttttccttgctgctgacttcctgttttaatttcaaacggaattcagaatatccctcgcatcctacctttttacaaaagcgaaggatcgtcgttgttgaaacatgaaccgcctctgccagctcgcgtactttcatatatactactttctcttcattgctgatgatgtaattatacacatccatctccaactgattaaaggattttatcatctcatgcgtaaacatatgaattcagttcccttctgtttttctctctattccataatcatattatgttctttagaagcagtgtttatcccgcattttaatcgtgtttttcattacttcatcgtcttcgccagtgaattgagaaatgcccacatctctggattagccaatacttttgccagaagttccgaatcgacttcatcagcaacgattataaatagtagacctgctgactcctaagatttcctgtaactcttgaactgtataacatcttttttctgacatttctttattctctttttgaaatatgaaaaaacaatattatatctcatttccgatggtattgctgtacattgcctgtgcattaacaatttctgattttgaaattgtgtctgttgtaacaatgcttatctggatcagtattccagctcttgctatatatatacgacatgatttcgggcatgtcaagagcagacgtcaaaaacgtccttcatttctatctccacaactttttcatcatggtctctctgtttctcactacctatattcatgtttgacctccttttccctggactaaaaaaaagcccagactagattttttgtaaatctaatctgagcgttttatatctctcaggtctgatttctcagacaagaaaacccgttttacagatttttccacccaaaaatgaaaaaagcagtaatgaattttcttaatcattactgcttcaaacaactgttctcagggggaatcgaacccccaactagcgcttaggaggcgcttgttatatccatttaactatgaaaacaaatgtatattacaaacaaatactaccctgcatccagatgtttcctttgaaacgtctgccaaccatcggctcaccgatgaggtcatttttgtttatacacacgctaaatattatatcattacatgatacttttatgcaatatattttttcatttgtaatgatatttttttcttctgttaactcaataatatctcccagcacgctgtactggtcactttcgatgccatatggcatgaaatatgttgttacgattgaaagaatatcctcgttttggattcttctcgtaatggatgagtataaatctatatcttccattgtgaggctttccatagcgccctcatcgccatccctggcctctgcaataagctgctttctatcttttttgtctgaatcaactgtatttaatgttttagcctttttttgtttcattggtagcaaaatacagccatcaactgatagtcctgagagcactgctccctttgcccttacctctatgtttatgtatgccttctctgacagataatcacacacattctgcagataaaatataagtgttacgccgagattagggtcatcacatacgcctgcatatgattccttctctgagtgcttttcgatatctattatctcatttgtagtcttttcgcttcccgtgaaatacggatagtaataatctatgtcaaagctatcatcgtcattgtatattcctctgactgtaattcccatattgggtgccacatcacatgacagctcggcaaattcattgccctcggaatcctttgttacctttagtttttccggcttatcaattatattgttaattacctcgtttaactgtttctttgttatatctgaaaatcctattgctctgaggaattggtgcattacttatttctcttttctttaaattacctgaagaattgaaatgtttttatcaagcatgagattcaatctgttgtgaagcatcaatttgccattattttcatttccaaaaatcatgataataggattctccggatctactgtctgggaaactactactccctcttcttcagcattggtctttactgttgtaccgacaggatatctggctattgatgatagcaggcacttaataattttgttatcatatctgccgccatcattttcctttatctgatttatggcttcctgcacacaaatacgcttacactccataccgcttatcagcgaatcaaacgcatcacatgcctgaattattctgcattccagttctttattcttttgcttcataggaaaacctgtgcctgccatattctcatgatgtgataaaaccatcttcattgatattggcgctatccagctttcctcatccaatgccgaatatcctaaaatggtatgctttttatattcaaaaagctccgcaggatttgcattggaaaaatccctgtttttatatcgtgtgacaataaaacgcagcccgatgtcatgtaataaacatcccaccgctatgttatactttcgcttttcgtcaagctttagctttcttgcaacaagcactgataaaagtgtcaccatgactgtgtgctcatataagtccgaattacgctcttttatatcaacaatcacatcatatggcatatcatttatatcatggacaatatcatttgcgattatttcaaattcctttaaggatttgccatcatgatatatatgactttccatcagtctgcgcactttttccacgtatttgttgaaaatagccgggtctactatagaattcgggctttcataattttcatacggatcctctaccatcactgattctattccaagtgactctataagtggcacataatcaggcttaatccttgtgccatttggtattaaaatatcatttttttctgttagtattggttccgcaagtacttcaccgccaactaagctgctgactgcttttatcctcataaactaaaacaccccattgttatttttctgcaggcatatttgcctccttggccatattcaacgcttcctgctcttcatctgctaaaacaataatggaatttccgccaacaatctccttgatgtatgtataacagccctcacgactgtgaacggcattgagtacaaagccatcatcctttccatttaacatggcaagtgaaaagcttagctttccgcccatctcattgaatgcatcatacttcacaagtcctaccttctggtatgaacacttcatgttagcaaataattcttctatattctttttgattgatgagtttgctgcaacaagttcatctacctcgtcaagtctcttgataattgtgtcctccaatgactttgcagtttttccactcataaacactttgtatctttttttgagtttaccggtctgcaccatatttataattatgaggatgagcagaataattaccactcccgccaatcctaatataatgtagtcggaatcgaatcctaaatattcagaaatcattttttactcctatctatattgtcgtacattttgcataaaatttaaatagtctctttgtctcattttctgtatgactttattatttttttcattaaatatacaaaatctaaatactatctaattatttctattgattttggactgaattgagcatgtttactattctatccagctcatcatgagaataatattctatttctatctttccggaattttcatttttcctgttaattagaacttttgttcccatattctttttaagcttttcctcaagatccttgtagattgcttccatctgaggattaaccggtttttcagactttgtctttttcttgttcttctgtaatgatttaacaagcttctctgtatccctgacacttagcttttggtcgaaaatctgttgtgctaccacatactgctgattctgatcttctataccaagtaatgctcttgcatggcctgtagtgagcatttcatctatcaccatctgctgtaccttttcattgagcttgagtaaacgcattgaattggtaactgctgttctgctctttgatactctctctgccacatcatcctgcttcagtttaaattcctcaagcagacgcttgtatgccaaagcctcctcaattggattcaaatcctctctctgaatattttctataagggagatttccataatctgctgattggtcaattttttgattatgacagggacttcctttagacctgccagctttgctgctctccatcttcgctcacctgcgacgatttcatagtaatcatccctttcctggcaaagtaaaggctgtaaaatgccaaactgttttattgattctgataactctataagtgcatcctcatcaaatttctttctaggctgttctctgttaggctctaccttattaatatctatcattacagcatccgctgcatgattgctctttggttttaccggctttgataccttgtctgtaattaatgaatcaagtcccttacccaatcctttttttgccgccatactatcttaaatatcctttcttgctattatttcctttgccagatttctgtagctttctgctccggccgatttactgtcatacatatttatcggaataccatatgatggtgcctctgctaatctgatatttcttggaatcattgtattgtaaatctttgtatccagattttcttttactgtctctacaacctgatttgacagatttgtcctgacatcatacatggtgaaaacaactccctctatctgtagctccggattaagtctctcctgcaccagattgattgtatgaatcagctgactaagtccctccaaggcataatattcacactgaataggaacaagaactgtatctgcagtagtcattgcatttactgtcagcatgttgagtgaaggaggacaatctataataataaaatcatagtcctcttttatgtaatcaactgcactctttaatatatattccttatcatttatgcccaaaagctcaatctctgctccggccagatttacattagatggaataacatataaattgtccaccaccgtattttcaatactctctgcaattgaacactcatcaagcatgagattgtataccgtattctccacttcgtccttatttacaccaaggccgcttgtcatattaccctgcgggtctaaatcaattgccagcacctttttctttttttcagccagacacgctgccaaattgatagaagtagtggtctttccaaccccacccttttgatttgcaactgctataattcttcccattataaatcctttcgcaattaacttaaaatttctgccgaatcatcatatttttaaattgtaaattgaaatcttacacactcaaattattatatcactcttaactgtataatgctataaaatttcactatgtatgcacattatttttaataattgaaataattattcatccaattcattttttattttgctaaatgtaactatacattcttgcccatttcatatactttatttaaaatatcatgcatatttttcacatcatcagtttttcttgtgtcatacgcaaatataataacgccctcttcacttccattttctccaaagcatgaaatatactgtctgaaacatttaatcatggtttgtacatttatttcttttcttgtagctgcagcacttaataaatagaaaatcttcttatccatactatcttcaattgcaaaagttctgtcaatcattcttttcatcaaagagggccaggtataaaagtaaaccggacatgctaaaacaattacatctgctttatacatttcatcatatatttcattcatatcatcgtcttgaacacattttcctccattttgttggcaaatagcacaaccactacaatctattattgttttatccttcaatacaattttcgttacagcattatgattttcaattgcgcctttggcaaatatatcagccattgttgcagtatttccttctgtccttggacttcctttaattattaaaacatttttattcatataaattatgtcaccttctatatcctttatttaaatttttaatcagtctaattattaaaacttagctttctcatattcactcattatatcatttaaatgtttcacgtgaaacattcctattttatcatttaatacctcatatttgtcactaaatattgtatttgatatactatcatatatttccgaattacataataattgagattataccacatcatataatttaaaacacaaaatattaacctatacaatataaaatcatacattattcatttttaaaataatatactatatgacatttattatacatccacacgtaaggaatccgacatacatatacatttcaaacgaatctacgcagtaacttaaagtatgtttgaaatcacttctatacatagcaacgctcgtacattgatgtacgagtgagtccatactgagccacgatggcgaatatggacggtggcgtactactgtctcaacctatatgtgatttcttacatactcttagttacggagtaaaacgagtgaggaatgtatatgcatgacggattccgtactattgccaataaactatattaaataatcaaaaagcaatgtttcacgtgaaacattttgtataattcaataaatatgtatagtacttccacaattcaaggaatccggtatacatatacattccaaacgagtctacgcagtaacttagagtatgtttgaaatcacttctatacatagcaacgcttgtacacggatgtacaagcgagtccatactgagccacgatggcgaatatggacggttgcgtcctattgtctcaacctatatgtgatttcttacatactcttggttgcggagtaaaacgagtgaggaatgtatatgtatgcttaattccgtactattgccaataaactaaatcatatattagaagaggaatgtttcacgtgaaacactatattttattatttaattctggagtattataccatagaatttttatagtacattcacagcgtaaggaatccggcatacatatacattccaaacgagtctacgtagtgacttagagtatgtttgaaatcacttctatgcatagcaacgctcgtacacggatgtacgagcgagtcaatactgagccacgatgacgaatatggacggttgcgtactactgtctcaacccatatgtgatttcttacatactcttagttgcggagtaaaacaagtgcggaatgtatatgtatgctggattccgtactattgccaataaactaaatcatatattagaagaggaatgtttcacgtgaaacactatattttattatttaattctcgagtattataccataggatttttatagtacatccacagcgtaaggaatccggcatacatatatattccaaacgagtctacgcagtaacttagagtatgtttgaaatcacctcaacacttagcaacgctcgtacacggatgtacgagcgagtccatactgagccacgatggcaaatatggacggttgcgtactattgtctcaacctatatgtgatttcttacatactcttggttacggagtaaaatgagtgcggaatgtatatgtatgacggattccgtactattgccaataatctaaatcatatattaaaagaggaatgtttcacgtgaaacattcctctaataaaattccaataaaatataaaaagtatattacataatctgaataatgttgttacggattgcaaataccgcagcctgagtacgatcagtaacctcaagcttcttgaaaatacttgaaatatgattcttaacagttctctcactaatcttcatttccttagcaatatctctgttaaacttaccaacagccatttctttaagcacttccatctctctcttagtaagagcatctatcttaagctcatcctcattcttctgaatcatcttagaattaagagccggaataagactaggctgtatataagtctcaccatcagcaatagtgaaaatagcctttttaagctcagcagactcagaatctttcagtacatatccgttaattccaatatctacagccttcataagatattctgtctcattgtgaacagtaagaacaagtacctttaccttagattttctgtcctttaatgcttttaatacctcaagaccattcatctttggcatattgatatccaaaagtaatacatcaggtctaaaggtctttaatttgtcaagacaatcctcaccattctctgcctcagcaataaccttgatatcaccgtcgagctccagcagatttttaagtccctctctgatcatagaatgatcatctgtaatcataatgttaatagccataatttaatcctccttatttacaggtataattaccctaactatacacccctcaccgggttttgatgaaatagatattttaccggaaagaagataaattctttccttcatcatagacaatccaaagcctgaattatcatctctggtaaactcaggaatagcagatgtatcaaaaccatctccatcatcctttattgtcaaagtaagtgattttggttcatactttaatgaaacattaatttctttggcatgaccatgcttgatagaattactgcaagcctcttgaatgaccctgagtaaggttagtgacacaagactgtctaccatgtactcatcaccggatgtcttgaaattgcatcttatattatttgaattgcgaagcttatcaagcgcacgctcaacagtaatattaaatccaatatcatcaaatgacataggtcttaaattataaatcatatttcgaagctcattgataatatccttcagtatctttccctgagacgtgagctcaagccggcacctgatagggtcaacatccataagtttaagacaaagctctgtcttgtgagtaagtgatgtcagactctgtacagtagaatcatgcaaatcacgagcgatacgctgtctctcactctcaacagtctgtaaaatcaccctcttaaaagcatcactatcctcttcgttgataacatcagatatggcctctgaaatttctacttcattagttgtctcatcagaattatacactctgataacactgttgatttcatcaatcttgcaatcaacatcagatatctgtttgtgtaaagactttatctgaggctcaatcagcttctgttcttccttaagttccttaactttactcttattatatgaattgatttcacgtggagtaaaagcctcaaagctttcatcggattttccttcaagcatctggataatcttgatattttctttaaaatgattctcagcggcagtaagcttttctataagcgcatacttgctgtcataaaattcatctcttgttttctctaaatattttttaaccataaccaccgaacatttgtttgtataattaatttatctacgatataattatatatcatttttactatatttaaaagcaattataaaaaataattgtataaaacttcttttttgttataatatagttataagaatacaaaatcaatatatcaaatttttcagataaaaacaaggaggttataatatgaaaaaaagtacaaaaaatctgctttttctcacatctgcagtgattgccggaatgcatatatacaacagagttgtagactctaatgccgaaaggaaaaattcactcaaagtagacaatggccactactacaaatggaaagaaggaaatatcttttatacaaaaaccggcagcggtaagccaatacttttaatacacgacaccgactccggagcatccggtgaagaatgggctaaagtagctaaaaagctttcgaagaacaataccgtatacactattgatttgcttggatgtggccgctcggacaagccttccatccaatatacaagctacatgtatgtacagattatcacagcctttgtaaatgacgtaatcggaaagcctgttaacgtagctgcaaccaatctgtcaacagctcctgtaatcatggcaaatgctctgtcaaaggatttatttaataaaatcatacttataaaccctgtatcattgcaacagcttaaatgcatacctgacaagagcaccaaatttaagcagaacataattaatctgccaatcataggtacatttatatacaataagcttatgagccctatcaaggtagatttactcttcagaaataaatttatttcaagaagccagctcatatcagataatatgaaggatgcatactatgagtccgcacataaagggcaaagccgcggcaaatatctttactcaagcattttatcaaactacatcaatactaatattgcgcccgctctcaagaacctggacaaggatgtatcaattatagcatcaacaggaataaaaaataatatggatgttatcaacaattaccataagctaaacagtaaatgcgacatcatccatattgcaaatgcaaagctttatcctcagttagagttaccggagaagacagcttcaattattaaaaaaattgttactaactaattctatactttaatctaaaataaggcaccgcctataactattcttcaacaattataacggttttttacaatggtttctttgaaggcagtccggcttttctcggatactttttgctcgtattcataaccttatcaattatgacaaaagagcgatgattatccgagtagccaaactgctctattttattcagctttcctcctagcagataaatggccgactttgcatctgccacctcgctctcgcactcacctgatttatatgacacaaagcagcctcccattttcacaaacggcagacagtattctgaaagagtagacagatttgcaactgctctcgatacacaaatatcataagctgccctgtgttccttatctctggcaaagtcctctgccctgccatgaactgcttcaatatccttaagctcaagcgcttcaataacttcatttaaaaatccaactctcttattaagtgaatctaataaagtaatcttaagctggggaaaagctatcttaagaggaataccgggaaaaccagctccggttccgacatcaatgatatttttttccgcgtttaaatctaatgtgtggcacaaaaacaagctatccaggaagtgtttctctattacctcgtcgaaatctgtgatggcagtaaggttcataaccttgtttttttcgataagcatgtcataatatagctcaaattgctctaattgtgaattatttaatgtacatttaatttttgataattcatcagtgaagtgtgtgaaatcatatttcatattttattctccattattattgttcaacgcttgtattatctgggtttaatctagaaaataaatcaggatttgagtattttaattgttccagaaatacaagtaaaaccgatatatcagccggtgtgacacctgaaattctggatgcctgacctatactaagcggctgaaattcattcaacttctgctgagcttcaattctcagacccgaaatagtattataatcaaaatcagtaggtaacagttttttttcaagcttcttaaaatgagagacctgcttgatctgtcttgaaatataccctgcgtacttaataagaatattaatctgttctcttgtgtcatcagataacttaggtctgtcgggatctatcggagcgagcttgtcataatccagctcaggtcttctgataagctcctcaagtgtggttccgttgcttagctctatactgttgtatttcttcagaatctcctgtacatcagcccttgcaccgatatttacatacgacactctctctatttccttatcaataagctctttctttttacatacatagtcatatctttcctttgaaatcagaccaacctcgtatcccttctcggtgagacgcaaatctgcattgtcctgtcttaaaaggagacgatattccgctcttgaagtcatcatgcggtaaggttctctatttttcttagtgaccagatcatctatcaacacacctatgtacgcttctgacctgtcaagtatcaatggctttttgccaagtatcttcatggctgcattgattccggcgataagtccctgacatgcagcctcctcatatccggacgaaccgttgaactgtccaccactgaacagaccatgtattttcttaaactcgagcgatgcatatagctggtttgcattgatacagtcgtactctatggcataagcatctcttactatcttcacattttcaagtcccggaagggtgcggtacatctcatactgcacatcctcaggcatagacgaagacatacctccgacatacatctcgtttgtgtttaaaccctcaggctcaataaatatctgatgtctttccttttcagcaaacttaaccaccttatcctctattgaaggacaatacctaggacctgttccctctatgatgcctgcataaatcggtgaacggtcgagattgtttctgataatctcatgggtcttactattcgtatatgtaagccagcatgaaacctgatcaatctgcacactttcaggatcagttgtaaatgaaaacggcactaccctctcgtcaccgaactgttcctccatcttggaaaaatcaagacttctcttatctacacgcgctggagttcctgttttgaatctgcgcatctcaattccgtgatctatgagcgactgagtcagatggttggctgccaaaagtccattcggacctgtatgagtgatcatctcgccggttaagcatctggctcttaaatatgtaccggtgcacagcacaatcgccttacaatgatataaagctcccgaagtagtttttgcaccgactatattattattctcatcggtaacaatctcagaaacctcaccctgtctgatggtcagatggtcggtattttgaagggtttttctcatttccatactatattccgctttatctgcctgcgcgcggagagaatgaacagcaggccccttcgatttatttagcatctttgactggataaaggtcttgtcaatgttttttcccatctcgccgccaagtgcatcaatctccctgacgagatgccccttcgagcttccaccgatattcggattacatggcatgagcgctatactgtccacgcttaccgtgaaaacaatagtctcaagtccaagcctggcacacgcaagtgctgcctcacatcccgcatgtcctgcaccaactacaacaacatcataattttcttcaacaaacttactgcacataactgcctactttcccatacaaaatttactgaatatctcatccatcagatcatcctcaaccgattctccgattatgagtccgagtgactcatacgcactcatcaaatcaatcgaataaaaatcctccggcatatcatcatcaatactgttcataacaagcttaagactttccttagcatctgacaatagttttttatgcctgatatttgtgatataaatctcatcattgaatgagacctgtccatcaaaaaacatttcctttattgtatcagaaagttcatctattcccgagctttcctttgcagaaaccgaaataaccgttttatccacaagcttttttatatcatctgccgacacctttgaagccagatccgacttatttagtaaaatgattgcctttttatctttaataaaattgataatatcataatcattatcatcgagtaccactgacgaatcaaccacatatatgattaaatcagcttcattggcatgctccatagcctttttcacaccaattttttcaacaacatcctctgtgcttctgatgcctgcagtatcaacgagatttaaggtgattccaccaatattaatctgttcctcaagcacatctctcgtggttccggctatatccgtgacaattgccctgtcacttcctacaagcacatttaaaagagatgactttccggcatttggctttccaatgattactgtgtttattccttccttcagaatccttccattatctgaggtttttaacagactatctatctccacatactcgttatccacaattgcacgtagtttttgtggataaccatccagagaaatatgttcagggtcgtcaagtgccgactcaataaatgcaatctcatgcaaaagctgctctcttatctgcctgatgcttccaagcacggctccgcctagctggcttaaagagcttttgagcgcaaaatcattttttgaatttattacatctatgacagattctgcctgggataaatcaatcctgccgtttaaaaatgcccttttagtaaactctccgggctctgccggtcttgctccgtttttgattactgcttcaagcactctcttcatcacatacacaccaccgtggcagtctatctccacagtgtcctccctcgtgtatgtattgggagccttcatcaaaagcaccataacctcatctattttctcatcgccgtcatatataaaaccataatgaatggtatgtgactgacaagcgcttattttctttttattattcttgcttttataaatcctatctattaccgaaagtgcatcatctccgcttatcctgataattccgattcctgacggagacatagctgtggcaatagccgctattgtatcattttgcatatgaaattcctcaaaaattctaagataatatatattcaaaaaggatacctgaaaccagatacccttttaatgatttatatctattatttcttaagtgtcacaacaacgtgtctgtaaggctcatcaccctcgctgtgtgtttcaacaaatctatcattctgaagtgcagaatgaatcactcttctctcaaaaggattcatcggctcaagagaaacaggtctctttgtacgcttaaccttgaatgaaatattcttggcaagattctcaagtgtctctcttcttctctttctgtaatcctcagtatcaatctttactctgtagtaattctcagactgcttattgatagcaagatttgtaaggtactggagtgaatcgagagtctgacctctcttgccgattaaaacgcccatctcaggaccgttaagctcaacatcaacatttctgttgtcctcatccactttgatatcaatagtaacctcaagcttcattgccttaaacacactgtcaaggaattcgcgaatctcatcctcaacacttgcctcggcctttttaaccttgatgacagcatcacggctgccaattccaaggaaaccattgcttcccttatcaattacctcatactctagcttatcgcttgttgttccaagtttaatagatgcctctgtcaaagcatcgtcaattgtttttgcagatacttcaatgtattccactattttctccccctatttgcgtgaattgcgttcattaaactctttaaccatattagcctttgaagcaagtgagcctgcctttgcattagccttgtactcagcggcctttgcaagcttctcctctgtgcctgctgatacagatacgtttgccttattgtcaattgactttgtcttaatctgagctgccttctttatataatcctcagacagtcccattttttctctcttcttctttgccttttcctcgttctttgccataacagcctcaagatcaagattctcaatatgtctgtttacgaagaactgctggatacctcttacaagtgcagagcagatccagtaaataccaagacctacaggaactgtaaagcagataacaaatgacataaatggcatcatgagattcatcatcttcatctggcttgccatctgatcattgccgtttgtagcctgtggcatgagcttgatattaagcatctgtgtcagatatgacagtacaggaataagcagtgcaagtattacaaaaagtaaccacttatcaggcttgtccgtaaaattgctcttaatgatataccaaggtgtatctgagatattcagtcccaaaaagtagttgaaatgaagtaacgcatcatgtgtcttctcaactgcgctctggataccatcaaaaaacttaccgtccataagagcatcccagccctttgaaggaagcttataaaggatatcaatgatataattgcttaaagtatcaccacttgcatcggcaagctttgaagccgcatttgaagcgttaagaccgcttgatgtaacaacattatacttttccatcagactgacaagtgtattctgatatccgcttgtctgctgaattgaatcaacaagccctgtaaaagagcccttaactccgctcagataagcaggaatattgtaaaatacacggtacagtgcaaacagaataggcatctgtataagcatctgcacacagcttcccatcggagaaataccgtacttctggtataaaagctgtgtctcctcctgcatggccatcattgaagcctggtcctttttatttttatatttagcctggatagcctgcatctcaggctgcattttctgtgatagcttagaaaacttctgctgctttatagtcagtggcaacagacacatgtagattataatcgtaataattacaatacttagtacaacgctctcaactcttccacctgtaatattagatataccactgtatatccaatccatcaggataccgagaagcttggcaattggtccaagaatagagcctggatatgcggttaataaaatgtccgacataaaaacctccattgctgctatggaaccggatcatacccaccctttgaaaaaggattacatctcaatatcctccatgccgcaagcagacccccctttatggcaccgtacttttgcacagcctgcaaaccatactccgaacaggtcggacaatatgggcatttcgttgatttcatcggggaaatatacttcctataaaatttaatcaaaaatattaagatacttttcaaaacgattccatcttctttttcattattcaaatattttgtttcttaataatcctgtgaagacctccaagatgtaaaacagcactttctatttccttataacccatatgccgcgctgcaactcttgcgatgactacgatgtccaaaccactatcgaacatgtcctcatgtagtctgtagctctctctcacgagacgagtaatatgatgtctaataacactatttccaacttttttgctaactgatatacctatacgattattttctgtgttatttttcagaacatacataacgaggtatctgttagcaaacgatacaccgttattatatacattctgaaaatccttgttttttttcaacgaatctgaaaatttcatttgacgctgtccttctaaaaacaatcaaaaatgaagaaaagaccacaaaaattgtggcctatgctgataatttttttcttccttttaatcttctggctgcgattacttttcttccgccagcagttttcattctctgtctgaatccatgaacttttgctctctgtctcttcttaggttggaatgtcatcttcatatatatccacctcctttacgttaaaaaacatcggtataattataacaaaaattcctgttgtgtcaaggattttctcaattttctttaaatttctacatatatttttttatcagtttacattccacaataaaaatgtggaaaacgagtttcttctatatatataataattcttgataaccgtctatattttgatataaaccacctattgtgaccaacatattgtggaaagttatcaagatatcaaaaagttatccacaatatgtgaataacatgttggtaactttgtataattgtggttaaaaaatgtgaataaagtatttttgtaaatctttttacattgcctaaatgccaaaaatagtgtactatatagtatgtatgggattgtggagaacattcccataatatactctttatatgttaaataatggagaactttgatggataaagtaatggaaaagtggaatgaaatactacagatggtcaaggaagagcatggtctgacagacgtttcctttaatacgtggataaaaccgcttgaggtgttcgccatagacggcaatacactgtatattctcgttccgtctgagcagatggggctcagctatatcaacaaaaaatattatcttcctcttaaggtagctataggtgaggtgacaggtatcgagtatgatatccagtttattttaccggaacaggctcagagccttaagtttaaaaacaacgatacccctcagcttgagccacagactcctgtaaagggggatcactcaaacttaaaccctaactatacatttgacacctttgtcgtaggtaataataacaggtttgcccattctgcttctcttgcagtggcagaaagcccgggtgaagcatacaatccgctatatatatatggtggtccgggacttggcaagactcatcttatgcattcaataggtcatttcatcattgaccagaatcctgataccaaggtgctttacgttacttctgaagagtttaccaacgaggttatcgaatctatccgtaacggtaattcttctgccatgacaaagttccgtgacaaatacaggactgtagatgtgctcatgattgatgatatccagttcatcataggaaaggaaagtactcaggaggagtttttccacaccttcaacacactgcagacacagggcaagcagattatccttacctctgataagccgcctaaggagatggagactctagaggagcgtatccgctcacgtttcgaatggggactgatggctgatatcggtactcctgactatgagacgaggatggctatcctccgtaagaaagctgaaactgacaattttgatatagatgatgatattttaaactacattgcttcaaacatcagctccaacatccgtgagcttgagggagccttaaacaagcttttagccttccacaatctcgagcatactcacatcactatggatatcgctgagagggagctttccaatatcatcacgccggacaagccaagggaaatcactgcacagctcatcatcgaggtcgtttcagagcatttccacatctctgtagaccagatgatttcaaagaccagaagcagcgagattgcacgcccaaggcagattgccatgtacctctgcaagaccatgacctctgattcacttgatgtaatcggccagcttttgggcggcagagaccactctactatcatccacggcatcaagaaggtcaccaaggattacgaggagaatgacagtacacgtactctcatagaaactatcaagaaaaagattaatccaaattagtttctacctatttatatatgtgctcatttgcatgttaataatttggttataaccttgcttttatttccacatgagcatgttaatgacaggttgaaggaaagtgaataaaaagttatccatttttatcatttttaattcaacaggtttttaatcaagttatcaagccgcttaaagcttgtctttaaaggctttgaaggggttttgaactttttaacagcccctaagaagaatattacgaatatcttttaaatatttatatatacgcgcaggaaggagtttttctaaatgaaacttatttgttcaaaagcaaatttactgaaaggtgttaatatcgtatcgaaggcagtacctacacgtactacaatggcaattctcgagtgtatactgattgatgcatccgcaaacgagattaagcttatggctaacgatatggagcttggaattgaaacaataatagacggaaccatcgaagaaagaggaattatcgctcttgatgccaagattttttcagaaatagtgagaaagcttcctgacaatgatgtaacaattgagacagatgcttccttcaagaccgtcatatcatgtgaaaaggccaaattcaatatcatcggaaaatcaggtgatgatttttcttacataccatatgttgagagaaatgagtctattgtcctctcacaatttacccttaaagaggttatcagacagacaattttttcaattgccgacaatgacaacaataaactgatgacaggtgagctttttgagattgaggagaataagcttcgagttgtttctcttgacggacacagaatatctatcagatatatcgagatgaaaaatcactatgacagcaagaaggttgttgttcccggcaagactctgcaggaaataagcaagattattccgggatccgcggatgaggatgtggttatctatatcactaacaatcatattgtttttgaatttgaaaatactactgttgtttcacgtcttatcgagggtgagtatttcaagattgaccagatgctttcatctgactacgacactaaggttcgcatcaataagcgtgagcttcttgactgtatagatcgtgctactcttcttgtcaaggagggagataagaagcctattatcatgaatatcacagatggcaatatggagcttcgcatcaattcatttatcggttccatgaatgaggacatcgatatcgacaaagatggaaaagatattatgataggctttaatcctaagttcttcatagatgcacttcgtgttatcgatgaggaggaggttaatttatacatggtcaatccaaaggcaccatgcttcattaaggatgatgagggcaagtttatttacctcattcttccggtaaattttaatacagcagcaaactaggagattttatgaaacagatttctataagagaacaggatgagttcattaagctgggacaggctcttaaaaaggccgaccttgtgagctcgggagttgaggcaaaaattgttattcaggacggtcaggtgactgtaaacggtgagactgagcttcagagaggaaaaaagcttcacgacggagatgttttctcatatgacggcgaaacagttaaggttgttaaataatgattattaagtcaatccaactgagtaatttcagaaattacgaaaaactggatatcagctttgacactgaaaccaacataatctacggcgataatgcccagggcaagaccaatatacttgaggctgcatatttgagcggcactacaaagtcccataagggcagcaaggacaaggaaatgatccggtttggcgaggatgaggcacatatcaggacaattgttgaaaaaaatgacaaggaataccggattgacatgcatctgcgaaaaaacggtgcaaagggtgtggccatcaataaaatgccgatcaaaaaagcgagtgagctgtttggtattttgaatattgtgtttttctctcctgaggatctcaatattatcaaaaacggtcctgccgagagacgcagatttatagatttggagctttgccagcttgacaaaatatatctgtctaacctgagtaagtataataagacattagttcagagaaacagactgttaaaggatatagcttacagacctgatttgattgatacacttcaggtgtgggatatgcagcttctcgagtatggcaggcatgttataaaaaagaggcgcgagtttgttaatgagctaaatgagataatacaggacattcacagcaatatttcaggaggcagggagaagcttatactcaaatatgagccaagcattgatgatatttttttcgaggacgagctgcttaaggcaagaagcagggatttgaagctgtgccagacaaccgttggaccgcacagggatgatatgcttttttcagtggacggtgtggatatcagaaaatacggctcgcagggtcagcagaggacatctgctctctcactcaagctttctgagattagtcttgtaaagaaaaatataaacagcactcccgtgcttttactggatgatgtgctttcagagctggatggcaacaggcagaactatctgctcaacagcttaagtgatacacagaccattatcacttgtacgggacttgatgaatttgtaaaaaatagatttcaggtggacaaggtctttcatgtcgtgaagggccaggtggaggttattgatgagtaaagaaatacagcagaacaatcaggaatacggagctgaccagattcagatacttgagggtcttgaggcggtcagaaaaagaccgggtatgtatatcggcagtacgtcttcgagaggacttcatcatctggtttacgagatagtggacaatgcagttgatgaggccttagccggttattgtaaaaatattgaggttacaatcgaggaggacaattccataacagtacaggatgatggacgaggaatcccggtcggaaccaatcataaagcaaaaaaatcagctcttgaggtagtttttacagtgcttcacgcaggtggtaaattcggcggtggaggctataaggtatcaggcggtctgcacggagttggtgcatctgtagtaaatgctctttccacatggctgacagttgaggtctacaaggacggaaatatttacagacaaagctacaagcgtggcaaaacagacgatacagtaaagattgttggacagtgtgacgagtcgcttcacggcacaaaggtgcattttctgccggatccggagatttttgaggagacagtgtatgactacgataccttaaagcagcgtctcagagagacagccttcctcacaaaaggacttaagattactttaaaggatgtgcgtgagaacagccatcacaatcatgtattccactatgagggcggaatcaaggagttcgtcgagtatcttaaccgtggcaaggaggctctctatgatgaggtaatctactgtgagggaacacaaaacggtgtttatgtagaggttgcattacagcacaatgattcgtttaatgattcaaccttcagctttgtaaacaatgtaatcacacctgagggaggtactcatctcgcaggctttagaaatgccctgacaaagaccttcaatgcctatgcgcgtgagaaaaagatacttaaggattcagatccggccctgacaggtgatgatattcgtgagggacttacagcaatcatcagtatcaagattgaggagcctcagttcgagggacagacaaagcagaagcttggaaacagtgaggccagaggagccgtagatgcagttgtatcggaaaagctcacatatttcctcgagcagaatcctgatgtagccaaaaatatctgtgagaaatcacttttagcacagagagccagagaggccgcaagaaaagcaagagacctgaccagaagaaagacctctctcgatggaggtactctgccgggcaagcttgctgactgctcagacaaggatcctaaaaactgtgaaatttttatagtcgagggagattcagccggcggttctgcaaagacagcaagaagccgtgctacacaggcaattttacctctgcgaggcaagatactgaatgttgaaaaggcaagacttgaccgtatatatgacaatgcagaaatcagagccatgattacagcattcggaacaggaatccatgaggattttgatataacaaagctgcgttatgacaagataatcatcatgacagatgccgatgtagacggtgctcacatcgctactctcatgctcaccttcctctacagattcatgcctgatctgatcaaggagggacatgtatacctggctacaccgccactttacaaggtggagaaaaacaagggtgtatggtatgcctacgatgatgacgagctcaagcagattttaaatgacataggccgtgacaataataacaagatccagcgatacaagggacttggcgagatggatgctgatcagctttgggagacaacaatggatcctgaccacagaattttgaaacaggtcatgatagacggagaaaattcatctgagcttgatgtgacatttaccacactgatgggtgataaggtagagccaagaaaagaatttattgaagctaatgccaagtatgtaacaaatcttgacatctagcagggaggagtaatttaagtggacgacaaaatttttgaccagatacagcaggtcgatttgaaaaaaacaatggagagctcctacatagattacgcgatgagcgttattgcaagccgtgccctccctgatgtcagggacggactaaagcctgttcagaggcgagtactctactctatggtcgagctcggaaatacacctgacaagccacacagaaaatgtgcgcgtattgtcggtgatacaatgggtaaataccatccacacggagacagctcaatctatggagcactcgtaaatatggcacaggactggtctatgagatacacactcgtggacggtcatggaaactttggttcagtcgatggagacggagccgccgccatgcgatacacagaggcgagactctcaaagatttctcttgaattaatcaaggatatcggcaaaaatacagtagattttgagccaaactttgatgagacagaaaaagagccgacagtgctcccatcaagatatccgaaccttttagtaaacggaaccacgggaatcgcggtaggtatggcaaccaatatcccacctcacaatctgcgtgaagtggtcaatgccgtagtgcgccttatcgacaacgatatcgaggacaaagaaaccacaattgatgagcttatcgatgtggtaaagggaccggatttccctacaggcggcataattctcggaacaagtggcatcaaagaggcttacagaacaggccgcggcaaaataagagtccgtgctgtcaccaatatcgagccgatggaaaacggcaaaaacagaattgtagtgacagagctgccatacaacgtaaacaaagctcgtcttattgagaaaatagccgagcttcataaggacaaaaagatagatggaataacagacctccgcgacgagacaagccgtgagggaatgagaatcgtggtagagcttcgccgagatgtgaacccgagtgtagttttaaatctgcttttcaagcatacacagctccaagatacgtttggagtgataaaccttgcactcgtaaacggagagccaaaggtattaaatctatacgatctgctcaactactatctcatccaccagaaggatgtagtgaccagacgtacaaagtttgatctcgacaaggcagaggccagggcacatattgtagagggtctcattattgcccaggacaacatagacgaggtaataagtattatccgctcaagccagactacacagcaggcaaagaccagattgatggagagatttggcctgactgatgagcagtcacaggcaattgttgatatgcgtcttagggctctgacaggtttggaaagagaaaagctcgaggctgagtataaggagctcatggctcagattgcgcagttaaaggcaattcttgccgatgagaaaaagcttcttggagtaatcagggaggaaatcatcgcaattgcagataaatacggcgacgacagaaaaacagaaataggctatgacgagtatgatatgtcgatggaggatctcattcctgagacaaatacagtcataacaatgacaaaggtaggctacataaagcgcatgagcactgacaatttcaaggctcagcaccgcggtggcaagggaataaagggaatggagacaatcgaggatgattatatcgtcgagatgctcatgaccacatcacaccactacctgatgtttttcacaaatacaggaagagtatacagaatcaaggcatatgagatacctgaggcaagccgtacatcaagaggcacagccatcatcaatctcatacctcttcagcctgacgagaaaataacagccatgattccaatcaaagaatacgaggatgacaagtatctgttcatggctacaagaaacggaatagtcaagaaaacaccgataaaggattatgagaatatccgaaagaacggacttgcagcaatcaatctgcgagaggacgacaaactcatagaggtcaaggtcacagacaattcagaggatattttgctcttcaccaaattcggacagtgtatcagattcaaggagacagatgtgcgctcaacaggccgtacaaccatgggtgttatcggaatgaatcttgcaccaaatgatgtaataatcgcaatgcagaccgcatcaatgggtgaggcagtgcttttagtatcatcaaacggacttggaaagcgtacacgaattgacgaatttaccacacaaaaccgtggcggtaagggagtaaaatgctacaagattacagaaaaatcaggcaatctcgtaggagtcaaatcagttgaaaacgatgatgagctcatgctcattacaacagagggcattatcatcagaatccaggtaagtgatgtaacagtgcttggacgaatcacaacaggtgtcaagctcatcaacctgaaagaaggagtgagcgtagccagcatcgcaaaggtagtagaggataagactctcatgccacctgaggaagctaaggaagagaatgacgaatcagaaaatagtgacgaagactcagcagagaataataattcacatgctgaagctatcgaaaataacacagaagcataactaaattcataaaagcagggtcataagatcctgctttttgcgaatgtggtgatactattcgagccttattgcgaaaaaatgtttacatgcaagcactatgcatcatatttgcgttttcagagactttgaaagtaataaataaacataatacggaaaaataaatatgtttatccacaaaaacacaaaaaataatcttgaattgtggataaaaggagccggaatttaaaatacagagaataaaaagagaggaaaagaaatgatcagggaaataaacgtttcagaaataacagctgcagtaaaggaaatgtgcatacaggcaaatcattttctttcgccggacatggacaaggcacttaaagctgcaacagcaaatgaagaatcacctttaggtaaaaaaatattaaaccagctacaggaaaacttaaaaatagcaggcgaggatatgataccgatatgtcaggataccggaatggcagtttttttcatagaaataggccaggatgtccattttacaggaggcgtattggaggatgccataaatgaaggagtcagacagggttacaccgacggctatctgagaaaatcagtggtaaaggatccgctcatcagggaaaatacaaaggacaacacacctgcagtcatccattactcaatagtttccggcgacaaagtcaaaataacctttgcaccaaagggctttggaagcgaaaacatgagccgtgtatttatgttaaagccggcagatggtatagagggagtaaaaaatgcgattctgacagcagtttcagatgcagggccaaacgcatgtcctcctatggttgtcggagtcggagtcggtggaacctttgaaaaatgcgcaataatggcaaaaaaagcgctgacaagagaagcaggcatacattcagacatagagtatgtggcagagcttgaaaaagagatgcttgaaaaaattaataatctgggtatagggcctggaggactcggcggaagcactactgccctcgcagtaaacataaacacatatccaacccacattgcaggattgccggttgcggtaaatatttgctgtcacgtaaatcgccatgtagtgaaggaattgtaaagaattactgcgtagaagaaagaaaatggcaattttaattgttacagctacagtgaaatgtgaaccgtaattaaaaagctataatagttacaggttatattatgctggaaaaataaaaatacagtaaaaataaaagaatcaggagaaaaaaatggaaaaacatataacaactccaatcacacagaaaataacaaaagacctgaaatcaggagactatgtatacataacaggtgaaatgtatgtggcaagagatgctgcacataaaagaatgatagaggcgctggaccgtaaagaagaactgccaatagatataaaggattcgacaatctactatatgggaccatcaccggccagagatggtcgtccaattggctcagccggacctacaacagcaacaagaatggacaagtatgccccaagactgcttgatttaggtgaaaaagcaatgattggcaaaggaaaaagatcaaaagaagtaatagatgcagtcattcgcaataaagcagtgtattttgccgcagtcggtggagcaggcgctctcctttcaaaatgcataaaatcatcagaagtaatctgctatgatgatctcggtgcagaggcaataagaaagatatacgtagaagatttcccggtaattgtggtaatagacagtgaaggaaacaatctgtacgagacttcaataaaagaatttaaaaaaatataaaaatactattgacaaaacaaagaaaattttatagaataaacaatgcgtcacgtaagtgcgtaaaacatttaaataatttatgtaaagactttggagaagtactcaagtggccgaagaggtgcccctgctaagggtataggtcgggaaactggcgcgagggttcaaatccctccttctccgctttatcttctacataaaataatttaaaaaagttcttgacaaatgaaaaacattttgatagaataaacaagctgtcgcgagacagagaacttaaaacagagttcaaaaaagtaaaaaagtgcttgacaaacgaacagcgatttgataaaataatcaagctgtcgcaagagagcaaaacaaagaacattgataactgaacagtgagaaaccttgaaagattttgagaatcaatcagaacgcttcaatgaaaattgaagacctttaaaacagtaaattcagatttatctgaatgaacgaattagccaagtttaacttgactgagatcaactttttaacatgagagtttgatcctggctcaggatgaacgctggcggcgtgcttaacacatgcaagtcgaacgaagcactttatttgatttccttcgggactgattattttgtgactgagtggcggacgggtgagtaacgcgtgggtaacctgccttgtacagggggataacagttggaaacggctgctaataccgcataagcgcacggcatcgcatgatgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagcggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgttggggagcattgcttctcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggtacttaaccgtaccttctcttcggagcaggagtgacaggtggtgcatggttgtcgtcagctcgtgtcgtgagatgttgggttaagtcccgcaacgagcgcaacccttatctttagtagccagcggtatggccgggcactctagagagactgccagggataacctggaggaaggcggggatgacgtcaaatcatcatgccccttatgacttgggctacacacgtgctacaatggcgtaaacaaagggaagcaaagctgtgaagccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttgggaatgcccgaagccagtgacctaaccgaaaggaaggagctgtcgaaggcaggctcgataactggggtgaagtcgtaacaaggtagccgtatcggaaggtgcggctggatcacctcctttctaaggaaatcgagtagagagtttttcactgttgagttatcaagctcaatctttccggtggcgatgcgcttttgggaaacacccgtccacatcccgaacacgatggttaagactgaagcggccgataatactatactggtaacggtatgggaaggtaggtggctgccggatttataaagaacagcatagcatatatgctttcaaaatagaacaggctcgaaagagctaacctacatcagcagggaagtgctgtttagatagctggttttaccagtgattagagattttaagagattaagatttctaatgactgataaaacagtcaaaaagtctgtgagaactaaaactggtaatcacagcagtgtaccttgaaaacttcatacaaatgatttgatgaataaatattctattcttaagaatatctaacaatcaagacatccgagaaacaaaaccaagttgtgaacaacaacaaagttctttaagttattaatgatgcaacgctatgcatcgaagagattaagcaaagaagagcgcagggtggatgccttggcactaagagccgaagaaagacgtgataagctgcgaaaagctgcggggagatgcaaataatccttgatccgcagatgtctgaatggggaaacccggtacgaagaactcgtatcatccatacgccaatccataacgtatggaggggaacccggtgaactgaaacatctaagtagccggaggaagagaaagaaacatcgattttgttagtagcggcgagcgaaagcgaaagaggccaaaccggagtgcgtgcactccggggttcggaccgcatttaagattcagtgattctagcagaaaggtttgggaaagcctgccggagagggtgaaagccccgtaagcgaaaggagagctgactgagcggaatccagagtacatcgagacacgagaaaccttgatggaatgagcggggaccaccccgtaagcctaaatactacttagtgaccgatagcgcatagtactgtgaaggaaaggtgaaaaggaccccgggaggggagtgaaagagaacctgaaaccctgtgtttacaagctgtggaagttctttaaatgaacaaccgcgtactttttgtagaacggtccggcgagttgcggatactggcaaggttaagcacttaaggtgcggagccgaagggataccaagtcttaacagggcgttaagtcagtatacgcagacccgaaaccgggtgatctatccatgtccaggttgaagttgtcgtaaaagacaatggaggaccgaagccacatccgttgaaaagggtgggcatgaggtgtggataggggagaaattccaatcgaacccggagatagctggttctcctcgaaatagctttagggctagcctcgatttagtcttatggaggtagagcactgaatttccgcgggggcgtcaaagcttaccaaagaatatcaaactccgaatgccatgtagatgatgatcgggagtcagactgcacgagataagttgggcagtcaaaagggaaagagcccagaccaccggctaaggtcccaaagtgcgtgttaagtggaaaaggatgtgggaattcgaagacaactaggatgttggctcagaagcagccatacattcaaagagtgcgtaacagctcactagtcgagagttcctgcgccgaaaatgtccggggctgaaacacgacaccgaagccgtggactcgcaatgcgagtggtagaggagcattcttaaaaccgacgaagctgtaccggaaggagcagtggagggataagaagagagaatgccggaatgagtagcgagagaaaggtgggaatcctttcggccgaatatctaaggtttccagagtaaagctgatctgctctgggtaagtcggggcctaagcacaggtcgcaagacgtaagcgatggataacaggtttagattcctgtaccacgcattatcagaactgtagggacgcatgtggaaagcacgagccgggaatggaaagaccggtacaagcggggtaggtgtacaataggcaaatccgttgtataatccgaagacgtgatgtggagcgaaataaagtagcgaagcgtgtgagccatgtgccgagaaaagctgctattgtgtaatgcgtgcccgtaccgtaaaccgacacaggtggatgaggagagaatcctaaggccggcggaagaagcattgttaaggaattcggcaaaatgaccccgtaacttcgggagaaggggtgcctgcgagagcaggccgcagagaataggctcaagcaactgtttagcaaaaacacaggtctatgcgaaaccgaaaggtgaagtatatgggctgacgcctgcccggtgctggaaggttaagaggagaggttagcgtaagcgaagctttgaatttaagccccagtaaacggcggccgtaactataacggtcctaaggtagcgaaattccttgtcgggtaagttccgacccgcacgaaaggcgtaatgatttgagcactgtctcgacaatgcatccggtgaaattgaagtaccagtgaagatgctggttacccgcgccaggacggaaagaccccatggagctttactccagtttgatactgggattcggtactgcatgtacaggataggtgggagacgaagaaggatggacgccagtctgtccggagtcgctgttgggataccacccctgtagtactgggtttctaaccagttgccatgaactggcaatgggacaatgtcaggcggggagtttgactggggcggtcgcctccgaaagggtatcggaggcgctcaaaggttccctcagaatggttggaaaccatttgaagagtgcaaaggcagaagggagcttgactgcgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgtagcaggtcccaagggttgggctgttcgcccattaaagcggtacgcgagctgggttcagaacgtcgtgagacagttcggtccctatccggcgcgggcggaggatatttgagaggagctgtccttagtacgagaggaccgggatggacggaccactggtgtatctgttgtcgaccaacggcatggcagagtagccaagtctggaagggataaacgctgaaggcatctaagcgtgaagcccccctcaagatgagatatccctccttcgggagtaagaccccttgaagactacaaggtagatagggcagaggtggaagcatggcaacatgtggagctgactgttactaataggtcgagggcttaatctggttaataacgaagaaaaacaaatcggatttgtatgaagttttgaaggtacaaaccttaataatcctcgatagctcaatggtagagcactcggctgttaaccgagttgttgtaggttcgagccctactcggggagttttttagtataatatatggtgacatagccaagtggtaaggccccggtctgcaacaccgtcatcgccggttcaaatccggctgtcacctctcttaaaatgactacatcagtttatgatgtggtctttcttttatatacaaaaagcaatataaaactgataatcagaattatattgcttttttaacaactatttattttttataatataactataacagtgaacatacaaatctatttttcttcttcaggatatttcataccccattcagctcttatatctgacataattttcattacatcatatgtatattgacagtgcatgaggggttctatttcatctgatgatgctgagcttacagctttttccatatcacgtacttcgtaatacagtgcatctgatgtatcaccggcatcaattacttctttatgaccatcctctgtatatgtaatagttgcctgcattcctcttggatactcaaagatttccacatatgctttgtcaaaagagagcgtagcgcgttttggctgctttgaatgaagagataatgtgacagttgccatttcctctgcatcattcataagcagaatacctgcctgttcatcaacaccggttggtgcatatttaacctgtgacgatacttgtgttggtgtttccttgaagaaccagcggataagagaaagtgagtaaactccaatatcaagcaatgctcctccggcaagcttacgactgaaaaatcggtttgtcatattgtaatccttgtagcttccaaaattgacctgaattaaatttagcctgccgagttgtccacttgcaattatttcgtttagctttttataaacaggcatatgatatatagtcatggcttcagcaagaataacgttattttctttggccagtgagacggcttcatcgagctctgcgatatttaaagtaatagatttttcacagagtacatgctttccattagaaagggcttttcttagataattgatgtgagtattgtgtggagtggagatgtaaatgatatccacatcaggatcataaaagacgtcatcaatgttgtcatatacctttgaaatgccatatttttgtgcaaaagctacggccttttcatgagttctgttggcaactgaataaagagtgcgtccttcctttgagagagcatgcgcgagctcattagctattacgccgcagccgagtgttgcccaattaagctgtttcatgtgaaatcctcctttttaacttaaagtattgtagctgtgatggtacataaattatttaaaatgttgtgaaataacaaaatataaactcattgatgataccttttgaccctttaatcataaaatatgtaccataatgaacatattctagcatgatgaattatgaattacaatgcatttagattcaaaacagtcaaaaacagtcaaatttgatagtgactaaattaaaattagttaatttgaactatattttagattataaactagtaatagaaaagatactaaaattagcaattaggcaagtaataaagatttatgtagtatattctgcacaaaattagaatattacttttgcatatattacacaatttgaaatttgaccttatataattttaacaattttcatggtgattatttgtgaatataaatgactaattatgattgacaatgactgattttgaaaatataataatactacaagttagatgattattgattttaataaaaaaggaaaataattgaatataaaagattaaatgatagtctttgagcaatttgaaaacaggggtgattagatgctggcggaagatagatgtaaaaaaatactcgatatattagattcgatgggaagtgtgactgttcagcagcttatggatgagcttgatacatccgagtcaacaatcagacgtgatctggtcgcaatggacaagaagggttatctcaccaaggtacatggtggtgcgattgcaaataatacgaatatccatactcaggatgagaaggttatcaacaggcttaagcagaatcgcagcgaaaaggaacagattgccagatatgcggcatcacttattgtggataatgattttgtttatatagatgccggtactacaacggcagtcatgattgattatattactgcaaagaatgtggtttttgttacaaactctctgactaatgccaagagaatttccgataggggatatacagtatatattctaggtggcgagttcaagtctactactgaggctattgtcggagatgaggctgttgtgacgctcgataaatacaattttacgaagggcttctggggaaccaacggaattactgtgaagaatggatttacgactccggagataaaggaggccatggttaaaaagaaatccatggagaatagcaaggagaaatacattcttgcggatgacagtaagttttcacaggtatcaagtatcaagtttgctgattttgaagatgctgtaattgttacaaatgcactaagcaatgacaactataagaaatacaaaaatattaaggaggtctaacatgatttacacagttacctttaatccatcattagattatattgttgatgtaacagattttaagacaggagtagtcaatagaacaaccggagagaagatttttgcaggtggtaagggcatcaatgtttccatggttcttaagaatcttggaatgagcaatacttcacttggttttacagcgggttttacaggaaatgaaattaaaagacttctaggaaaaaaaggcgttaatactgattttatagaggtggaggatggtatttcacgtattaacgtgaagcttcgctcaaatgaggaatccgagattaatggtcagggaccggtaatcactgaggacaacattaaaaagctttatgagaagcttgactgcttaaaggagtctgatgtgcttgtgctcgcaggaagtattcctgatgtgatgccttcatcaatgtatatggatatcatgaagcatcttgagggccgcggaataaatatcgtggttgatgcgacgagaaatctgctcacaaatgtgcttgcgtataagccattccttatcaagccaaacaatcatgagctcggtgagatattcggggttgaggttacagacaaggacgatgtgataaagtatgcaaagaagcttcaggagcagggcgcaagaaacgtgcttgtttctatggcaggtgacggagcagtgcttgtgaccgaggatggacaggaatttaaggcacaggctcctaaaggaaagctcaaaaactctgtaggcgcaggtgattcgatggtagccggatttgtttacggatacctcaaatcaaatgattataagcaggcatttatttatggagtatgtacaggaagtgcaagtgcattttctgaggagctggctacaaagcctgaggttgaagcacttattgataaatgggacagtgcttccaattaaacaaacggtatcaaaaaggttgatataaataattaatatattctattaggaggaatgatgtatgacaatcagggatttgttggcagctgagagtatcaatttaaatggtacgcctgccggaaaaaccgaagcattgaatcagtgtattgatttgatggcaaaaagtggcaaaatagccgatgtggagaagtatcgcaagggtgtttttgcaagagaggaggaaggcacaacaggaattggaatgggtatagcaattcctcattgtaagtctgatgctgttactaaagcaggtcttgcggcaatggttgtaaaggacggggttgactttgaatcactcgacggtacacctgcaaagattattttccttatcgctgcaccaaacacagaggacaatgtgcatcttcaggtgctcagcaagctctctgttatgctgatggacgagcagtttacaaattctcttatcaatgccggctcagtagatgagtttttaaatatcatcgacagtgctgaaaaggcaaaggatgagaaggaggctgcaaaggaggcaaaggaacctgttgaggtgaagaaggacgatgtatttatcgttgcagttacagcctgtcctacaggaattgcccatacttatatggctgctgaggctattgagaaaaaggccaaggagctgggatatcaggtaaaggttgagacaagaggctcagccggagctaaaaatgtactcacagatgatgagattgcaaaggctaccggtgttatcgttgcatgtgatacaaatgtgcctacagaccgttttgacggaaagaaggttattgagtgtcaggtttctgacggaataaataagacagaggagctcgtaaagagaattgctgccggtgatgctcctgtatttaaggcatcaggtaaaaaagaggcttcacattcatctattggtggaaaggagagcattggacatcagatttacaagcatctgatgaacggtgtttcacatatgcttccgttcgtagttggtggtggtatccttatcgcaatcgcgttccttatcgatggattcagtgttgaccttaattcactgccggctgaccagagagcaaatttcggtactattacacagggcgcagcattgtttaagggaatcggtggaacagcatttggatttatgcttcctatccttgcaggctttatcgctatgagtattgctgaccgtccgggtcttgcagttggtttcgtaggcggttcaatcgcagcaaacggtacatcaggcttccttggagcactggttgcaggtttcgttgcaggatatattgtaaatctcttaaagaagatattctctaagcttcctgagagtcttgatggtgtgaagccggttcttctttatccgctgcttggtatattcctcataggcgttataatgcagtttgtagttgagcctccaatcggagctttaaatacagctatcaacaacggtcttaatggacttaacggtgcaagcgcagtagttctcggagtacttctcggaggaatgatggcaatagatatgggtggccctgtaaacaaagccgcttatgtatttggtacagcttcaatcgctgccggaaactacaatatcatggcagcagttatgattggtggtatggttccaccactcgcaatcgctcttgcaacaatcttcttcaagaacaagttcacagcagaggagagaaaggcaggacctacgaactttatcatgggattatcatttatcacagagggtgcaatcccattcgcagcatctgatccgcttcatgtccttccggcatgtgcagttggttcagcagtggcaggtggactttcaatggcatttggatgtacactcatggcacctcacggaggaatcttcgtagtacctacaatcggaaatccgttaatgtatcttgtagcattagtaatcggagccttcattgcatgtggattactcggattactcaagaaaaaagtaagtgaataagcaatcctcaattatcatttaatccaatctataaactaatcaacaaaggcactgcttcggcggtgtctttgttgttatgttgttatacaaaaattaaaaatataaacattctctgaaataacagcctcatgccttgacgagtgaattttcgaagcttaaagtagtattaggatgaaatagtaagtcataaaaagcaattatttatgagacttaaatataaaaaacagtgaggaaaatcatgggtaaggttataggtatagatttaggaacaacaaacagctgtgtggcagtattggagaacaatcagccggtagtcataactaacagcgagggtcagagaacaactccgtctgtagtggcttttacaaagaatggagagcgactggttggcgaggctgcaaagaggcaggcagcagtcaatgtggacaggacatttttctcaataaagagacagatgggaagcgatttcagggcaaaggtggacggaaagctgtattcagctcctgagatttcttctatgattctcagaaagctgaaaaaggatgcagaggactatattggagaggcagtgacagacgctgtaatcacagttcctgcatatttttcggatgcgcagaggcaggcaactaaggatgcaggaaggattgcggggcttaatgtgcttcgaatcataaatgagccaacctctgcggcactcgcatacggactggaccacggacagcagcagaaaattcttgtctacgacctcggaggaggaaccttcgatgtgtctgttatcgaaataggggacaatctgatagaggtgcttgccacagccggtgataatcatctgggtggagatgattttgatgagagaatcacaaattatcttgtcacagagttttacagacagcagaatgtggatctgagaaaggataatacggctatgcagcgtgtcagggaggaggctgagaaggcaaaaaaggtgctttcatcatcatcctcaaccactatcaacctgccatttatcaccactgtaaagggacagccggtccacatggagatgaacctcacaagggctgagtttaatgagataacaaaggatctggtggagagaactgctattcctgtcaatcaggcactttcagatgcggggatttccgcagcagagcttggaatggtgctgttggtaggaggctctacacgtgtgccggctgttgttgaggaggtcagaagaattacaggaaaagagccttcacacaacctgaatcctgacgagtgcgtggcactcggtgcagcagtacagggcggcaagctcggtggagcaattgtcgcaggcagcagtgcggcagagattatactgatggatgtcacaccgctttcactcggaattgagacggtcggtggtgtctcaaccaaaattattgacagaaatacgactattcctacgagatacagccagatttttacaactgcaggaagcttccagacctctgtggatataaaggtactgcagggtgagaggcagtttgcaagggacaataagctgattggaaacttcaggctaaagggcatcaagccggctccggcaggtgtgccgcagatagaggtgacatttgatatagatgcaaacggcattgtgcaggtttctgcaaaggacctgggcacaggaaagcatcaggagattacgattaccgcaagctcaaatttgtctgattctgagattgagcaggctatccgtgaggcacaggagtatgaggcaacagacggacagagaaaggcttatattgatgcaagaagtgaggctgatacgcttgtgcgccaggtggaaaatgtcatggctgacaaggaaaaaagaaaggctatggacagcgcacagaaaaaaagtgtgaaatcatcgctttcgtatgtgaagaagcttatttcaaggacaaagcccggaaatgtgagcgaagagcaggctgccgagataaagcatgcggcagatgagctgagaaatgcggcagcgggattgatttaattataaagggctgtaatcagtagctattattattcatttggctatttacgagaagcggattttcatataaaatatgggtaagtggtgagtattcataaccaccctgaatagttataatgttaatttaaatccgaggaaatagaaaatgaatgcgaacgataaaacagaaaaggtactaagagaaattcatatcatgctctcaaaggcggagccgtataagccggagccgagcagggtgatcataaacaagcagcaaatgatagatttacttgctgagctgaataagtgtatatatgcaatacaggatgagtatgagcttactgaacagagtcgcaatcacgcagagagagagttcagaaagaaaggggatcagatagtctgggatgcaagcagaaaggctgaggatgtgtatgcagcatcggttatctatacggatgaggcgctttcaagagtgcgtgatatcatcaatgataccaacgagtcacttgaaaagctgtgcaagaatatgaaggataagattgcagagcaggagaagatagttaaaactaaccagtatgagctcaagggacagcttcaggatttgtccgatacggagaagtatcttaagattatcgatgacagaaataaggagatagaacgtcagaaaaatgcaggtaaacctgtagaggagcgtactattgacaatgaagagaagtccatctatgcaaacagacagactgaaatcaaggtaaatatggattatatcagaaaactgggacttgctgagggcgaggacctgggagatggtgtagtgggtgaagtgaagcttgcagacgatacacctgatgccggattaaatcatagcaatgataaggatgaagccaaggctgccggctcaaaatcgtctgttgatgaggattataaggcaataagcagaaaagccggcaatccacctgttatcaacacaaaggaagggaaggagctcacagacggtatccacagaatgtggcagagcatcaccggaaataaaggtaaatgaaacacacctatgtaatataaagcagcagttcaaaacagaacggctgctttttggctgtgcgcctagcggcgcacgtttctaacgggttaaagtcccgaatccgcccggtagtgggaaggatatagccgaaggcaagggtgtccatcgtgagatggaatctgaaggaagctggatgtgaggaatataccaactcacgggcaaatctctggtctgacgaacagaaatctcatatgaggtcatgcatgtgggtaagacagcaacccatgttaaagcccaataactacacggaatcatgcatgataaatgaggcagatggatggagaggaagaaacgtgtggtacctagggaggtctgtgcggtatgccttgaaagaggtaaccattgcataaagcaatgctgaacgcatagaagtcagcagaggtcatagtagccgagaggtgaaggaacgaatcagtaggagtcttgagtatgaccgagaaaggaggaatgaccgtctatggcagaaaacattgaaaacaatggctgttcgcaaagagataatgcggaacatgaagggtatgtgaaagcgtctaggtcattcaatcggatatggaaagaaagagacagtgcacagccgagacttttggaaacgatactgtataaagacaactttaacagagcgtataagagagttaaggcaaacaagggagcgccgggaattgatggcatgaccattgaagaggctcttccatatctaaaggaacatcaacaagagataactgaccgcatttatcgtggaaagtatactccgtctccagtaagacgagttgaaattcccaaaccagatggtggtgtgcgaaagcttggcataccaacagtgatagaccgtacacttcaacaggcaataacccaacagttagtgccaatctatgaaccgctgtttgcagatggtagctatggctatcgtccgaacagaagtgcaaaagatgcaatacttaaggttaaggagtatgcagaacaaggctatacattcgctgtagtccttgacttgtcaaagtacttcgatactcttaatcacgaaattctcatcaatcttctacgaaagaatgtaaaagatgaacgtgtagtacagttgataaagcgctatctgaaaagcggtgtaatggaaaacggagtggtcattgacacagaggaaggctcaccacaaggtggaaatctatcaccattgctggcaaacatctacctcaatgagttcgaccaggaatacctgaaaagaggtgttccatgcataagatatgcagatgacatcgtgcttcttgcaaagagcaagcgagcatcagagagactcttggaaagcagtacaaaatatcttgaggagaggctgaaacttacagtcaaccgagaaaagagccgtacagtcagcgtgtttgcaatccgaaattttaaattccttggctttgcattgggaaggaacggaaaaggcatatatgtccgagttcatccgaagtcatggaagaagtttaagtccagactgaaggagttatcttcccgtaagcgatgtcagtcaatcaagccaagccttgagaaaatcaaagtatatgcaagaggatggcttaactactacggaattgcaagtatgaagagcaacatagatgacatcaacggatggctctatcacagaatacgcatgtgcatatggaaacagtggaagaaacctagaacgaaatataaaaatctagtcaagctgggaatcccagaacactatgcggcaacaatagcaaacagtcgcagaaagtattggtatatcagcaataacaaagctgtgatttgggcgctgaataaagaaagactgataaacagtggcttttacgatttagccacagcctatcagtctgtgcacgtcaactattgaaagcgccgtataccgaacggtacgtacggtgctgtgagaggacggcggttagtcaccgcctcctactcgattatatttaaagtgggtaatattaagcagattttaagaaaaacaaagtagataatctgataaaatatagctgactaacggcaggagaaggtttctgttcaaaattcatagaaggaggataatatgacaatattagtttgtgatgacgacaaggaaatagttgaggcaattgagatttacctgatgcaggagggctacgacgtggagaaggcttacgacggcatacaggcggttgaaattatgaagaataaaaaaatagacctcatgataatagatgtcatgatgccaaagctcgacggaataagagctactctgcagatacgaaaggaaagcagggtgccgataatcattttatcggcaaagacagaggatgctgacaagattttaggcctcaatgtgggggctgatgattatgtcacaaagccttttaatccgcttgagcttgtggcaagggtaaagtcacagcttcgcagatataccactctgtcaagcaatgatgcagccggagacaaggtttatgaagccggaggccttttggtaaatgatgatttaaaaaaggtgactgtggatggtgaggaggtgaagctcacaccgattgaatacaatatactgcttttactccttaaaaataagggaaaggtctactcaataaacgaaatatatgagagcatatggaacgaggaggcgataggcgccgacaatacagttgcagtgcacatcagacatatcagggaaaaaatagagataaatcctaaagagccgcgatatctgaaagtggtctggggagtaggctataagatagaggacaacaaatgaagcagtatacgataggaaaaaaagcagcggtcatagtcttacatcagctatgcatgatacttatggtaacaggagtgtttgccacaggctatgcattcaggcacgatgcgcatgaaaatattgatatatatacactaatatctcttgcgggcctggtaggcagctttgtgagcctggcatatatggcaaacgtggcaggcagaaaatcagaggatgattacacaatatactatttaccgattgacaaggtatactctgatgtgatgctagtgatatttacactgctcatggtatttatgggaaaagtgatttcaggcgtaaaaaaccagcattttgactatgcatcactcattatgacggccggtacatttacttttttgtttgatctggcttttattattttataccagagcactgtaaggaagataaaaggcaatatactttacacacacagcctgatgtacaagggctatgagcttttgaaaagagttattgagaaaaaggatatccacacacaaaaaaataaagagataatgcgcatacaggaggcacttgaagctatctcggaaggagcgcttgacactacactcaatgtcaatgagtttcatgggcagcagaaaaaggtggcggaggctgtcaaccatatacgccagggtcttatgagctcggtaaatgagagccttaaaaatgaaaaactaaaggcagacttaataacaaacgtatcacacgatataaagacacctctgacttcaatagtcaactatgttgacctgcttaagagggaaaatctggaaaatgaaaatgccaaatactatatacatgtgctggaggaaaagtcacagcgcttaaagcagcttacagaggatttggtagagacatcaaagattacctcgggaaatgtgaagctcaatatgcaaaagcttgatctggttgagcttttataccagaccggaggtgaattcaatgagcgatttgagtcgagaaatctgacaatagttacaaaaattccatcagaacagatatttatatatgcggatgggcgtcagctttaccgctctattgaaaatctgtatactaatgccgcaaaatatgcactggaaaataccagagtgtatgtagaacttgaaaaggcagataaaaaggcagtttttacaataaagaatgtgtctaagaacgagcttgacatagtaagcaacggaaatgtagacctgacagagcgttttgtgaggggagagaggtcgagaaccactgaaggaagtggacttggactttcgattgcaaagaatctgacccatttgatgggaggaaaattcgaaattaaggtagatggtgatttatttattgccacaattacctataatattatataatagtaaataaaagaattttgaaatacacatacggaggtagaataagtgaaattatatgaaaatggtgcttaccttttaaacggtaaggaagtaataattgatggacctaaggctaaggcagctgtcaaaagcaagaccggcatggacatcgataaacagacagctaagcaggagacaattgcttacggtattttaaaggagcacaatacatccggcaatatggacaagcttcagattaagtttgataagcttacatcgcatgatattacatttgtaggtatcatccagacagcacgagcttcaggacttgagaaattccctatcccgtatgtacttacaaactgtcacaacagcctttgtgcagttggtggaacaatcaatgaggatgaccacatgtttggtctcacatgtgcaaagaagtacggtggaatctatgtaccacctcatcaggcagttatccatcagtttgcacgagagatgcttgccggcggcggaaaaatgatacttggttctgattcacatacacgttatggtgcacttggtactatggcagtcggcgagggtggacctgagcttgttaagcagcttcttgaacagacatatgatattgatatgcctgaggtagtaggtatttacctgacaggagagccaatcaagggcgttggaccacaggatgtcgcacttgcaattatcggagaggtattcggaaacggcttcgtaaagaacaaagttatggagtttgtaggaccgggtgtgtctaatctgagcgttgacttccgtataggtgtcgatgttatgacaacagagactacatgtctttcttctatctggagaacagatgaccaggttaaggaattctttgagattcacggtagggctgaggaccacaaggagcttaatccgggtgaggtggcttactacgacagattcattgagattgatttaagccagatccgcccaatgatagctatgccattccacccaagcaatacctatactatcgatgagctcaatgcaaacctcatggatattctcgatgactgtgagaagagagctgaggtaagctttgacggcaaggtgaagcttgatttaaagagtaaggtaagagacggaaaactgtatgtagaccagggaatcatcgcaggctgtgcaggcggtggatttgagaatatctgcgatgcggctgacatattaaacggacattcaatcggagcagacgagtttacactgagtgtttacccggcatctactccaatatacatggagcttgtgaaaaacggagctgtagcaaagcttcttgagacaggtgcaatcgtaaagactgctttctgcggaccttgctttggtgcaggagatacacctgccaacaacgcattctctatccgtcattcaacaagaaacttccctaacagagagggttctaaggtacagaacggacagatcagctcagtggcactcatggatgcacgttcaatcgctgcaacagcagcaaacaagggcttccttacatcagcagcggatattgatgtcaactttacaaagccaaaatatttctttgacaagactatatatgagaaccgtgtatttgacagccatggagtggcagatccttcagttgaaatccagttcggaccaaacatcaaggactggccggcaatgagcgcgcttcctgagaatatgctccttaaggtggtttcagagattcatgatcctgttactacaacagatgagctcattccttcaggagagacatcttcatatcgttcaaaccctcttggacttgcagagttcgcactttcaagaaaggatcctgagtatgtaggcagagcaaaggaaatccagaaggcccagaaggctatagagagtggtgagtgcgcaggaaaggctgttcctgaggttgctgaaatcatgggagtagtaaagaaaaaattccctgaggcaagccatgagaatatgggcttcggaagcacaatttttgctgttaagccgggtgacggctcagcaagagagcaggctgccagctgccagaaggtactcggaggctgggcaaatatcgcaaacgagtatgccacaaagagataccgttcaaaccttatcaactggggaatgcttccattcatcatcgatgagggagagcttccgttccacaacctcgactatatcttccttccgggaatcaagaaggaaatcgaggatgcaaagacggagtttgaggcatatgttgtcaaggatggtgaattaaagccatttacactgaagatgggtgagctcacagatgatgaaagagagataatattaaagggatgtctcatcaactataatcgtaaataaggagagtttaatccgatggaagaaaccggaaaagctggtaaaaaatcaaacattgagataaatgcagataagggtgcgaagcagaattcgcacccggggcgtgaggaatggccacatctgatcagaataggtgtcatggtatttgtcacgtttgcagtcagtatactgtttttctttgcactgtacagatttgagggctttgcaggcatatggagcaagctgcttgcggcagcaatgcctattataatgggacttgtgcttgcatacctgatgaatcctgtcatgctgtggctggaaagatgctttaaaaagcttctttccaaaaagatgaaaagcgaaagcaagctgcgaaaggtttcaagagctcttgcaatcacaggctcggttattattctggtagcgattatttcgctcctcattgcggctattgtgccttctgtcatagcaagtatatcaggacttatgaagacactgccaaatgatgttgcggcattcatcaacatgataaagaacggcaatttcggggacagcaaaattgctgagctcgcgagcacaggtttacagaatgcaaccgactacattgaggattatgccacagaaaagctgattcctgaggcacagaagtatgttgcacagattacaaccggtgtgatttcggtagtcagaggcttatttaattttattatcggaataatcgtgatggtctatgtgatgagtattcaggagactctcgcaggacagagcaaaaagataatatatgctgtctgcaagccaaagacaggcaatatcatcattgagacgatcagaaagacaaatgagatttttggaggcttcataagcggtaagattatagattcactgattataggtgtgattgcatatttcggatgtctgattttaaggattccatcatcggtgctcgttgcagtgattatcggcgtcacaaatgtgattccggtattcggaccgtttatcggtgcaattccatcgttactcatagtagtaattcagagtccgtggcatgcgctttatcttctgatatttattgtcgtgctgcagcaggtggatggcaatataatagggcctaagatacttggctcatctaccggtctttcgaccttctgggttatgtttgccatactaatcggcggaggaatgtttggttttcttggaatgttacttggtgttccaacctttgctgtgatatactatattgtgaaaagagttgttaattatgctctcaggaaaaagaagcttcctgaggacacaagggattatacaaagacaacaggcgtagataccaaaaataataagcttaaatacgagtaggtgaaataagtggataaatacgaatacaatctcaagctggatcagataaaagccctaagcgccgaggagggctatatgagcgcagcagagattgcggatagcataaattggaacaaaattaaaaatgtaaatacactcgttaaaatcggcgaaatctacgagaaggccgaaagataccaggatgcaagggacatacttttaatggcctatgaccgttcaccaatcggcaggatgattatatacagactggctgaggtcgccatcaagatgggggattatgatgctgctacagagtattatgatgagtttgttgagatagcgcctcatgatgatatgaagtatgtattaagatatgccatcaaaaaagggcagggagcttcatttgatgagcttatcactattcttgaagagtacaaggatgaagaatacactgaggagtgggcatatgagcttgcatatctataccacaaggccggaaaagccgataagtgtatagatgcctgcgatgagctcattctgtggttcggagacggaccatatgtggagcgtgcgctggagcttaagatgctttatcagccacttaccaaggctcaggaggaaaagtacagacgattcaaggcagagaaggaaaagccggctaagataaaggatgaggctgaggtcactgagataggtgccatggagatggtaaagggcggagagatagtgcatgatgacgtaactattccgcagattactgtaaatcaggagaagttcaatactgtaaatttacagcaggagattgccaagggtatgcagcagatcatggaggccaagggcaagaatgaagttgctgatacgatggataccatcaaaaagatagttgaggatattccttatctcaagctcgaaaaggagcaggaagagtatgtacagcagccggaagagacagagcatatcgctacagatgaagagatagatggttcacttaagttgaatttcaaggagcttttgggtgaagacgctgacggacagatgtctatggtcatgagtgaaaagactcagcttgagcatcagattacaggacagatgtctatacaggatgtgcttgaagaatgggaaaagaccagacatgcggctgaaattgcccttaaagaggctgagcagcagaagcttgagtcagctaaggcaagagcacttcaggaggcaggagacatcatggagagactaaatgatgtcattccaaagctggatgcaggtgtcactccgaaggaacttcttgaggaggagtatttgaaggtcccggttgatattatagagcagaaagctgccgtgaaggagcctgaagaagagcagaaaccggatatgcaggagctttatgcagaggagactgtggatgaagtacaggagccgcaggaagcaccggaagatactatagacgaagcacaggagccgcaggaagcaccggaagaggctatagaagaagctatagaagaagtgcaggagtcacgggaagtacctgaagaggctgcagatgaagccagggaaccggttggagagccggaggatataattatggcagaggagtctgagaaagacgagatactcatgcagccgactaccatgatgcctgaaataacagatgatatgttaaatgtcgatgatgatacatcagatgatgagacttcacaggagaaagaaaacgtttctgagaagagagattttgatcatgtgacatcatttatcgagcaggaaatagccaagatgacagcaaaaaatccgggactggagaagaagctggatatggctaagacaagaaaaatgccggatatttcattgccggaggatttagacagcgaagaagatgactcgaaattgaaagaaacaaaacatataaaagagcttacaagcgaacagaaagctatattttcatatttcataccggtaaagggtatggaggatcagatctgcaaggcatataatgcagtgcttgatcatttcaacaggaaagaaaacgcatccacaggcaaccttattatacagggagagcagggatgcggaaagacaatgcttgctacaagctttataaaggtattacaaaaagatggtgaacagcttacaggaaagatgggcaagattgatgctgccgcactcaataaaaaggatgtgcagcaggtagtcagaaagataacaggaggctgtctcatcatagaaagagccggtgacatcgaccgcagcatagctgcccagctatcatttttgatggagcatgatattacaggaacactctatatacttgaggatacatcaaagggtataaagaaggctctctcaatggatgagggctttgcatccaagttcacggaaaagatatcggttcctatttttacaaatgatgaactcgtattgtttgccaaatcgtactctgcagagcttgggtacaagatagatgagatggctattctggcattgcataacagaatcagcaatattgagaggatagaccaggctaccactctgacagaggtcaaggatataattgacgaggccatagacagggaggctcacagcggacttaagaaggctataagtattctgacagccaggcgatatacagatgatgaccgaattgtactcaaagaggatcatttcagggaaaaataaatacttatggggggtatatatatgtgtaattttacagcaatggattgttacctgtttggtcaggcaacacactatgatatctacaagaagatgggtgctcacttagctgagcgtaaaggaaaaaaaggagtgtgctttgacgtctgggcgccacatgcgagggaagtatacgtgtttggtgagtttaacgactggaatgagaccagtcatgagatgaagcgtgtagagccggaaaccatgggagtgtatgagctttttgtaccgggagcgcaaaagggtcagatgtataagtttattatagtcactgaacagggtgataagctgtacaaggcggatccatacgcaaactacgcagagcttcgtccgggaacagcgtcaatcatcacagatatcgagcacttcacatggactgacaaagagtggatggataagagagcagcaaagtcagatgctgatgtatattcttcacctatggctatatatgagtgccatccgggctcatggatgagacatccgggcagggatgatgagggcttttatacatacagggagcttgcaaaatcactcatatcctatgtgaaaactatgggatatacacatattgagcttatgggtatttcagagtatccgtttgatggctcatggggatatcaggtgacaggctactatgcacctacatcgaggtatggagagcctgaggattttgcatactttgttgatcagtgccataaaaataatatcggagtaatcctcgactgggtacctgcacatttcccaaaggatgcgcatggacttgccaatttcgatggaacagccacatatgagtatgcagacccaagaaagggagagcatcccgactggggcacaaagatatttgactacggtaagaatgaagtaaagaacttccttatcggaagtgcacttatgtggatagaaaattaccacgtagacggactccgtgtggatgcagttgcgtcaatgctttatcttgactatggaaagaacgacggacagtgggtgccaaacaagtttggaggaaataagaacctcgaggcagtagagtttttcaagcatatcaatacactcatacttggaagaaatcacggaactgtaatgatagccgaagagtctaccgcatggccaaaggtaacaggcaaggtagaggaagacggactgaacttcagctacaaatggaacatgggatggatgcatgacttccttgattatatgaagctggatccatatttccgtaaaaataaccacaacaagatgacatttgcgatgagctataatgagagtgagaaatatattctggtactgtcacatgatgaggtggtacatctgaagtgttctatgctcaacaaaatgccgggcttagaaggggataaattcaagaacctcatggcaggatatgcatttatgatgggacactgtggaaagaagcttcttttcatgggacaggagtttgcacagaagcaggagtggagtgaggaaagagaactcgactggtatctgcttgagaatccggagcataaaaagatccagaactgggtaaaggagctgcttcacctctataggagaaaccgctgtctgtatgagctggattcaagctgggaaggctttgaatggataaatgcaaacgatgcagacagaagcatcttcagctttatcagaaagagtaaggatggcaagaataatatgctctttgtcatcaatttcacaccggtagagagacctgattacagagtcggagtgccaaagcacaagacatatcagcttgttttagatagtgaggatcctaagtttaccggcaaaacggtacaagagcctgtaaagaaggctgcaaagggcagaggcaaggcagcaaaacagtcatataagaagctggactataaggcagtcaaatcagagtgtgacggcagaccattttcatttgcttatccacttgcgccttacggagttgctgtatttaaatactaatataccggtaaacagcagggtaaaggaccgcgccaatttaaggcgcggtctttatttttgcgtattatatgtcgatatatagtaaaaagataactattcagaaccactgagaacaaaaaaactgatgcgtcatgcttgcatgtaagcagcagattttcttgttctcaaggtggttctgaacagttggataaaaagtacgaagtatgaatatccataaataaaagcagcagagatggtatatatgcagggcacggagcaggaaatatgcagatagagaatttgattaataaaagcacagatacgaaaaatacggacgcaaaaaccataaatgacatgacagcgggtatgcgtgtgtcagactacataaagacagacagcagtgacaatatgtcaaaaaaggcggctgttgtcggttcgtcaaattctgttgatatgtcggatacgatatatgcaagaccacaggctaaaaacgaagccgggaacaacgatggcacagatatggcagaaaatctgctaaatgacatgaatcagacctcagaaaacaggcgaaatgatatgattgtcactgcaagcaccaccacgagtgatgattacaaagctgcaaaggatgacggctacgatgtcattgtcactgagaccgataagattaaagcagtgctggcaaaggcaggcgtagatatatccatatatggagatgatctgagcaggcagcagcttacagacatcacgggaagccagactgaagcggccatgcttgtcaatcagatgaaagcatatgatattcctgctacagatgacaatataaaggcaggtacagatgccatagaccgggcaaagagccttacaaatatatccaatgagacaaaggcatatctggtcagaaataacatgaatccgacggtttccaatgtatacaaggctacatacagcagcagtcaggtacaagattacaggcagaaaaccaaaatgacggagatatcagaggagctttttgaggagcttaagccacagctaaagcagatattagaggaagctcatatagacagtagtgatgagaatctgaatcagtgcagatggctgatagatgaagatatagccgttacacctgacaatgtgttgcttgcgaatcaggtagactgcatcaacgcagcagaagaaaatttgagcagtgatttttatgcaagggcagtgacagaagcactggcaatgggaaaaaaggctacagatgccactatgtcacaagatggtctgacatttgacatggcaaagaaagcctgtgatgtattaggtgaggcgaccgcagatgacattgtcacattagagtcagataacatacctgtcacgatagagaatctgtcaaagcttatagctgcaaggggcaaggatagtgcagcatcgcaagtctcagcgaataaagctgcggataatcagattacagacagccgggaagcaaggcttgtgacagctcaaagaaagcttgaggaagcgagactttccatgacagcagaagccaacctttcactcataaaaaaaggagtttcaatagacacagagcctattgaacgtgtagtggagctgcttaagcagcaggaaaataaatactacggagcgctgtttggtgagagcagtgtagaggcatctgatgatagggtacgtatgtacaataatgtctgtgatattttcaatcagatgaagcagcagccggcgtatgtactgaccttggaatctgctgatgacactgtgtatgagctgtatacagcaggtaaagcaatgaagcagtcattagaagcagcagcctcaggatatgagactcttatgacatcaccgcgggcagatatgggagacagtatatcaaaagcatttcagaatgtggatgatatacttaaagagcttcagatagatacatctgaaagcaatcgcagggctgtgcggatacttgcgtacaacagtaccgacatcacagaggacaatataaagcagataaagtctgtagatgagcaggtgcagagagcattcagcgatatgacaccggcggtgacgattgagatgataaaaagaggcatatcaccgcttgatatgagcatgagtgacataagtgaaactgccagacggataaaatcagaaaatcctgacgaaagggatgagaaattcagcgagtttctctggaagcttgaaaagaaaaatgaaatctcagaggaggaaagagactcatatataggcatatacaggcttatttcacaggtggagcagtcagatggtgctgtgataggctcacttgttaatcagggagcagatattacaatgaaaaatctgcttacagcggtccgggtacgaggaaagagtgccatggactataaggtggacgatacctttgccggagtggacagtgtaagcagtggcattaaaattgactcacagatagaaagcgcatatcatacaaactgcctaagggatgtgcttgatacactttcacctgagaaaatggagtttgtgcagtatgacagctggcttgatatgactccggagcagttaaggcaggctgtatatgaggccaacgaggataacgcactgtcagagcaatatgccacagaacagctaagacagttcaatcacgcagtttcggcgcctgagaacgtatatgcttttctagagaaatatgatgtaaaaacaaccgcagtaaacctcatggctgcgtcacggctaatgaaaaatccgtcagaggcagtaagaaatctctgggagcgtggagacagtgctacggcaagggctcttttggatgagactctcagacggttttctgagtcggtcaaaaatccaaaggagcttgcgcaggcgcaggaaacgctggctgatacagcagagcatgttatggattcgatgattatagaggataggcacaccggttcaatagacctcagacagatgaagctattatgcagtcagctaaggatagcttcaaatatgtcgagacaggaaaactatattgtaccaatagagactgcagacggggtcacaggtatgaagcttagtatagtaagaggcgaggataaaaagggcatggttgacatattccttgaggataaaaaatgcggcagagtagctgcatattttgaggcaaaggaaaactcagtatctgctatgatagtcacagacgatgagcagactaaaaagctgtttgaagataatatcactatgtttgaggcaggaataagtgatggtgaacagcgtgtgcgcatagatgtggcactggagcatgatatatctgcaaaagagtctaagatgtcagataatgagactaaaaagcagcttgatggcagtgaaagcgtccagacaaccagactatatcacatcgcagagcagtttattgtaaatgtccagcgggtgattgcgcaagatagtctgtaacaccgatatatattgcatgtgccaggtcatcctgatagtttttgtcagtaagaagaagtgtctcagcaggattactcaagaatccacattctacgattacggtcggggatgtggattttttaagtataaagtattctttattgggcttaatgcttcgtggctttgcgacacaaagagaagtgtttaaagctccaaggacagaggatgcgagctcttttcctgcatcagaggcttcataatagaatacctgtggaccgcagcttgaattgtcctcaaagctgttttgatggatactgatgctgactgccacattgcttttagacatcagggcagttctctttgtcagatcatctgtctttggatgcttggaattatccggggcgaggtcgcagtcggtggttctggtcatgacaacagtaaagcctctgttttcaaacagctgtttaagaaccattgcaatactcaggttgacatccttttccatgacgccggaggtggaaatcttaccgggatcacttccaccatgtgctgattgtagtttacgcaaattttgatatgtattccccagtatatatggggagttagaaatgtattgagattagatagcctttttctccaagtcctcacagtaaacgcttgaaaataaatgttcaagttcatttccgaagttgtatgagattttaagtttgcggttttcataaactgttatctggtctatcatttccacaataatatctctgtctaattcttcaatgtctttcagttccaacaaccgccttaaccacggtgtttcaaaaacatcttctgttacactttcctttttcttttcttccagcgtttcaatctgtttggagtaaagcgtttctttttgttgatagtcctctcgataagaaagaaattcttctttagaaatcagttcgtctttataatcttcataaattgactttttcaacttcttcactctttcaagctctgcttttaactttgtcagttctatatctgttgattttctgatttttgttgctgtgaaagattgtgattttacaagttcctgcaagttctctacattgcggataatcttctttaaatctcccagcacaatatcattcaatacttgaaacgggagcgtgtgcggagtgcaataatcttttccacttcttttgtaagttccacaatagaatgaataggacttacttccgtcaacacgtcgccagaaatttttcatcattgcccgaccacaatcgccacacttgataaaacctgcaaagatatttttatttgtttctaaatcaatatccctatgctttttcgtcagcaatttttgtaccttatcccacagttgacggtctataatcggttcatgtgtattttcaacccttatccagttttctttctcaactagacgctgtttgcttcgcatacgttgatgtttctttccttgtaccatgtttccaatataaatctcattttgcaacatcactttaattgtggaatacgtccaataagaagttttctctaaacggttgcaatttttgtagttttcgccgttaagctttttatattccgacggacaaaggataccctctgcatttagtatttttgcaatgctttgttttcctattccttgtgcatacatggtaaatactctttttacaacttcggacgcatattcatcaatcacaagtttatttttatttgcaggagatttcttataaccataacttgtaaaagctccgataaattctcctgctttctgctttgattttacagtcgcttgaattttattagaaatatctctggcatactgctcgttgaatatatttttaataggaagtaacatatcgtatgcctgcttcatactatcaatattatctgttacagaaataaaacgaacattaagctctggaaatattctttccaaatatcgccccgtatcaatgtaatctcgtccgaaacgggaaaggtcttttacaacaacacaatttaccttgttatcctcaatgtcagcaatcattctatgaaagtctggtctattaaaattcgttcccgtaaaaccgtcatcaatataaacatcatataggataaagtcatcatgcttgttcacatattctgttaaaagttttctctgatttcctacactatcgctttcttccttatctccgtcctctcgtgataatctgatataaatagccacgttaaataagtttgaacctttttgataaatcatttttccacctattcaactgccgtacctatgataatattataccataaagtacggcttctttccattgttttcaagggtttttccctcttgatagtccttttttaacatgagatttcacgatacggacaagcaattcctctacggaaaatttacctaaaaattcccgttctacgatatattgtgcaggttcttttttagccaagttatcagcccccttagtcagctatctattctcaacatacgcacatgggcttatccaatatgcgtatttttcacaatgttacagaagcagacagacggctttggaaagctccgttagtatctcaactattcccattcttgtgggcagaaccgcaccatgcggacgtatcattattctgtgaggataggtcgtggcaaaacgacttttccaatagtcgctctcggatcactgcgtgggtcgctcgctttcttttgaaaaggtcgtggcgtacagtccccgtggctcgctatctcacaaacgtatctgtctgctttattcagttgtcaaagagctgtggcgaaagcgtgttgctttcatgtaaaagcaggtgcagagcaggaaagaggggattgaataaatcatgctctgcggttactgcttgttattcttcttcgatttctaaggcaatatcaaaccctaaaatcattttaataagtgcttctctgataagtccctttaactccatatctacaacaatatagacattgccgtattcatcatagagtggacgcagacagcactttgatatgtacgggtcataaaacgccagtatcttttcaatcgctttttcgtccccgtccattgcttgtgaaagcaagtagtaggacggcttcttaaatgtttgcttcatttttactgtttctcctttagtaattttttcataagtgccaatgagttatgccgattttggaatacaccgcttctggaaatattctgcttttttgcaatttcttcgttgttcatttccaagaaataatacatcagcaaagtttcacggttacgctcggacaactgtttcaaggcttctgccaattcatcatcatagacacgaatatcattaccgcatacattgaaaattgtatagtccgtatcatagtcgtcccagatagccagattttctacaacgatttctggaagttcacaaaagagtgtttcttccttttgtcgtcgttttaatttcttctgatagtccttaacaacatgtcggacaactttcttcaaacaactttcaaaacggcattgaactgttttctggaagtcagacggtttcatcaatctcaccccctttccgttacgacgtggaaagtagttatccctctttccgcaccatatagggaacggcaggtgtgatttgttaagttgaaaccgaaaaattttaaaaaatttttttagacatgaaaaaagcccgcacaaaacatatagttttatacgagctattagagctataagatatttagtttttaataaaatgctgttaggtagtgtatgattgtatagaattatgcttaaaatgttccataatacaatcccccttacagcacttgttttgtattacacttttgtcttttttgtaatcttgtaaatatattcttctggcgtagggcgtttatttccaaaatactttttgaaatttgcctgcacttctgggtcggtgctgttcataacttcatcaatggtcgcttctatattcgcccgaacatcagtcaatgatacaccgccagctttcgcacctgctttcaatgctttctttatatctcgcctttttaaaatagccataaacaacacctttcttttttattttatgagtaattgaacaacggttaccaatgcccaaacaaaaaacagaacgccgtccattttagcaatcaaatttaatgctttattttcaatcttttctactccacacagagcattgaaattcatcaaggagaaagccaaaatcaataaagagtagtttgacaaattgttattatccccattataaagtgcaaaagcatatccagcccaaagaggaagtaacgcaatcaaagtaaaaccttttaaaaacttcatgtcctttctttcacttgaaaaataattccctttcaaattatctgttaaatgtttgtctgccataatcgcaactcctttcaaaattattggaaatttttccgacttcattataatctatttcaatctatatgtaaagtatttctaactatttgaacaaaaaaattcacgcttattttgttaacaagcatgaaatctttttactattcaattttcttatagattaggattgcgacaacctgtaccgtcaacacaatgttgtacatccattgagtaccgttagccattgtcaaccaatcaacgattagaagtttggataatttagcatagacattcatcaaaacaatatatgttatcgtagagaaaatacttgctttcccaataattgcccgtcctctttcatctcgtgatgttttcaaaaagaatagtataattacggcaatggtaatcactaaggtataccacatgcctattttaaatactgtcgtactactgagaatcgactttaatagttcaatcatttttctgcctcctcaaagtcaaataaatcttcaattgctacatcaaacacttttgcaatgctgtatgccaaaagcatggacggattgtatctgtttctttcaagctgaataatggtctgtcgtgacactcctacaaggtcagcaagttcttgttggctcattcgctttgtagctctataaatatgtatcttgctatcaaaagaatatttttgcttcgccatttagccaccgccttatttcaaattcagcttattataacatatttcttactttttgtgtaaaatttctaattatgctattctacaaaacgtgtaaatctgtaccaaaatacacaccttatcattatttatccaataatcttccagttgctatccttatgtagtacaagctcatattgcgatacctgcgtcgcttttgtctgattatcaaggaattttacagctaccttgactttcacattatccccgtcctttgtaaatactgggtttatcaattcagaataaaggtagtccctgccgataggttcaagtacatttcccgatacatagtaggcaagctctttttccgtcgctgttgggtacagcttaaagaatgtttccagaaatgcggtggcgtcgtttacagtatcagcgtccacacttgtgtctgcttctggtgtcttaggatcatagtctgatttttcgattgctggtgcaagtgtagggttctgaacgattaccatatccccgtcagcgtctacatggacttttacggtataggttgccttgacattgcttgtctgttctccctcttttatctgctgatctacttcgtaggtagcagaaaaagtgtccgttcccgactgctcgatatgccacacaatcatatctgtaactgtggagctggtcggtatgtcggttctaatggtatccacattcaaatcctgcaattcctttgtcagataaccgttgattgcctgcgtccttgcttcaatcgcttctttgctgttactccatgtataataggatttcgcaaagtttttcacgaaattttcaatcccgttggtgtcctgcaagcgaagctctatcacttctttttcatgggtcgtgtgctggtcgatagccgtaaaattcttatataccccaaagctcacgcttgcgataagcaccacccacaatgcaatcacggttttcttatgtgtgcctaccttgacagtacgcacctttttttctttgacattttctgtctgtttcttattcttcttaaacatattttcaagtcctttctattgttttactcgtcctgcaccgattaagtgctgttgccagtaactactacttaggtctgcatatcctatcgggtcgcctgcatggtacattttgttatttcctacataaatgccgacgtgggttacatacgaaccagcgttataggtagaatggaaaaacaccaagtccccagcctttgcctgcgagagtggaagatgttgggttgcgtcatactgtgcttgtgctgttctcggcaaagagataccagcttttccatagcaccattgcacaagtccgctacaatcaaaggaagtgttcgggttactgccaccatatacatacttccagccttgatatttcaacgcttcattcataatcgcttgtgccgtcgcattatcaaaatgtgccacggtcagatattgattgactaattccacatagaacatatttccatagccataccgccagcccccattcttcgcaacagctatcgggttggtgtaggttactttctttccacccgacttctcacgggcgaagctctctgcaaggttaaaggtatgtttctttccttttcctgccacatatcccacataaccaccgccatagttataggactgtatcgctacattcaaatcgtcgataccttgatttttgcaggaagaaagcagggacgcaaaatacttacacccctgcttgattgagctttccgtatctaaagagttaggcggtaaaccaagactttccgaactctgcataacatcttctaccgtaccgccactttctacttgaatgatagccagtaacacattgacatactcggaaataccgttttctctggcgtatttttctaccataggctgatgtttcaagacttctgcggataagttcatacccgtaatgccagaagaaaaattgctgttttcgtcgtcgctgtccgcactaatcaagacaccaaagaaaaggactatggaaaagaggataggaaacagactgccaatgagagcgatatgtttcagtttcattttttcttctgtcctttcttcattacaagactacggttcttttcggtatgttccgttgtacgctttgattgttcaaaggtctgtgtctttgtagtacgctcctctttgtaattttggcgtgtttcctttgataccgtaactttttcaacattctgcctatgtgctggctgtgccgactgggtcgcttttctatcagaagcaccagaagataacggacgctctttgataacatttgtcttgactggctcacttgctttcggagttggagctatggcaggacgtttcacttcctgcgttttttcaacactcggctttggaatggttgaagctgtggctggtcgctcatggggacgggtagctcccgttgtcgctgatccgtcagcctttcgctgtgcctgccttgcttcttgtgccttttgaagctccatacgcttatcagcgatattctgtctatgctgttcctgcttttccaagcgtcccgtctgtctggactgctgttcctgcaccatgccacgcttgaagtcggacacgctggactttgccttttcctttgcggaatacaccgcataagcggtctgtgtcggcatatccttgatattctctttgacagcgtttgccttatctttcactttatttttcgtatctaagacagcacccacctttgagcctgcacgctgtcccatgctggaagatgtattaccccgactgtcttttgtggctgtgttccttgtcggttttctgtttgaaatcgtgctacctgccaccgcaccagcaacaccgccagcagtaaccgcaccagcaagccgtctttccatacgcctagccctatgtcgcataaacagatacggtctgcgaaatatcctgcgtcccatattttgactgtcgccagcattcaaagagaacatattcattaagtcgcctaacttgataaagatacctgcgaaacacactatctgtaagaacgccaccataaaaaacgggtactccttagagatgttataaaacatactggaaatactgaacgccaccgttacaatgagtgtaattcctgcccgtgtcattatggtattaaacaccctcacgattgcctgctttgccagattttcttgactgggtatcatggaaagaagaaaactgataggtaaaaacattgcaaagataataaagagtatctggcttaacatcattatcccagtcagtaggaatacaaagattgtgatacctatattaaaaatgaataggaagaacaccatgcctaaacggttcacgacctgcggtatcgtcagattgttgttgtcattgtcctcgatttctgttttcacgacttcttctctggtctttccgtcctcgtcctctgggcttgccgatacgagagcttcgacacggtctgtcccgatttcctctgcgttgctgttgccaaattgcagaagtagccacggctgttccacttgaatagaaaataagctgtcccgtatcaagtccacgctgtccttgccctcgctgtcagaattagggagcatgatttttgttcccaagtcaagtgaagcggtactgatgtctgatgaaaactcatttatcttcttgatgtagtcgggagcataggcgataaatgaagcggacagcacgaacaccacaagaaaattgataaccgcttgaaccgctttgctggtttctctttttatcagtcccgtataggcaacataaataccaatgattaaaattatcagtaatagagaacccacataaaatcccgtacttccaaagccattctcggtaacacctgcaagtgtctgtatgctctttccgatactgtctgccatatcgttaataaaatcaagtttataggcttcctgcaccacataccccgttgcattgcttaaataaaggcttatcgtccagacaaagttggtaatgcaatacaaaccatactgtactgattttccgataccgtccagccagttccacggaagccacgaccagctattatccacataaaaatcaagctggtagttggaaaggggatattttgagtatagattttctgcgtttatggtatcgtccacaagccccgtcgcatgagccaccgttcccagaagtgaaagcaggataagggagagtgccaccacgaacagagccattttgagaaagtgaagtatcttcctttttgtgaacgcaccttttatcctttctttcatcactccacctcatttctctgtacgggcggtctggtatcaaaggcgtgtagcagttcttcaaagactgggtgtatctgtaccacaccgacacgcccgtataagtcctgcaataagcattgtccgttctccaaatcacgcaagcgtttctggttgttctcgtcgtccttgtcgataccgaaaaattctaaggtctgctttatctcgttgatgtcggtactacgaaaggcaaatttcaagccgatattgtttttcagactttcctttgaaacatcataggcagactgggtaacaaaataaacgcctgcctgcatagctcgtccagcacgaaccagcttgttagagagcgtttctccttgtgccacatttaagaacgcccacgcttcatcaaggtctacaatcttaaaaatgcttctgtcgctgtgaatgaagtcgagtgcaaaggtactaatcacaatcagcattgccaccgataataattcaatggttgtgtattcattaaaagtagtgtctttatctggcaatactaagtccgctacttgaatgatattgagctggttatccagactgatagcattttctaccgtaccgtctgaaaacagcaggtgtgcaaagtcgtagtccgtgaagctgtcgatatggtctgcgatatttcttgatatgggcgtatcttcacggcgtagctcgtctatcacatggagcaagccccgactgtcgctctgggtaacggaacgcaccgcttttcgtaacacggggaatttttcgccgtccctagaggaaatacccgtaaggaatgtcaagatgtcgattgccagactttcagcgtctttaacattcttcataatcacaaatgggtcaagaagtcctgcattatctttatcgctggttaggtttacgatattgatttcatgggcgatttctgggagcgtttctttccaatttccacgctcacttttagggtctaacagaagtgcttgaccgccaaacagcaccgcataatataccagaagattgttgcagaacgatttaccaccgccaagcgaaccgacaaaagcagaagctaaagcgttggtaactgtaccttttataccttgactggcaagggacggttgcaggtacacatttcttcccgtatcaacggaatagcccatatagatacccgtagtttctcctaactgctgggtcgctccaaagccaagcccagccaagaagtctgattttacatactgcacatagtcgttgatatatcgcttgctggcaggaagaaattcagaatgaagcccaagcatatccccagcaggacgcaccagctttacattgaggtcgtcgtaaaagtccttgacttcatcacaacggcgtttcagctcgtcaagatcgggtgcagacacccgtatcacgtagcttaacttatacatactttctttgctctggtctaagtctgtttccagctcgtccacgctgtctaaagcgtccaccacatttgagctggtttcacttccagcttgataagcgtgattgtcaaggtctttcaattcctttttcttgttgcggactgtcgttaatgcttttcggttctccacgatttctacattcatagaagtatcaacggggaatgtgaattgctgttgctggaaatagaagatttcagacgacggaaaatcaagctccccgacaatcgcattgacgataaaataggacacatagctttccttgtcctcatgctccaatcttaaataccgctggctttcctcaatcacacaccttgtcggacggataaggtcgtagtattttatcagcgtttctttctgtaatttcttctttggtagctggtactcataatcttcataggcgataccgtccctaccgtaaagatgttccatgagatacccaaaatcgttgatttccaagcgacgcaccttaaagcgacgggagattttattttccagtaacttttccattttcgtgtaacggttgatttcatcattcggcatggaaacaaaatcattcatcagcgtgtggttcacttcatggagaaattccgtgaacgtcagccacgccgattttttgatgttcttcagattgagctgttcttccgtaaccatgagcttaaagccaagaaaaaagcggtagtccacttgattgtccccaatcatagatactaacgcttcggtctgttcgtctatcttctgataggcaacttcctttaattttcccgttaccagcttctttgactgctcctgcatacttcgtatggaactttccgtcgctatctgcaaggcatgaattttaccctcacgggactgtgcgataagctgtcggaaactgtcatgcacgataaatttctgctctgcggataggaaagaatagttgtacggtatcagctcatagtaggcgaatacctcattgtccttgttccagacaaggttattgtcaatatattttatcgggaacatacttcacactccttactgccgtgattgtttcgttgaatgtttccttttgcagttttacggcttttcctgcataagtgattttcggtcgcagggcataagttatctgtgatttcaaaaagctgtacggcttctttccgtcaaaggttttctgcgacataaaccaagtgagagcaacgggaataccgaagtatttgagaaatgctccctcaatcatggaaagtgggggaatatccccaaacagaatgatgataaattctgtaatcacaaaccatgtaatctgtgtaaaagtaacgggaaagggcaagttaaagtcattgattgcatacaagactttttccacgttccagatacccgtataagatttaatctttttcaagttctttcagctcctttcaaaatagaaaaggacagccatgtttcagactgtcccttaaaagagaaatacgctgtcagtagcaaccatgcttgtcgctgatcttccagcgttagtatggtatctcgcacatacctcggcttgtttcaataaagtaaccgcccatatccaaatctcgcccgtaggcttcatagtcaatgtagttctgtaagctgggtggaatgtcgccaagtgcctgcaattcgtctatgtagtagtaggcaacgtctgtcatggtttcacagtcgggataataataaatatcgtccttatgttctacgacttcttccagcgtcccgtagtggctgataaattcgtccagacactctacgatatagtcgggaagttcctctatcatttcatacatctcattgagttcttcaatggaaacatactcgccaatcgcaatagggaagttatcggtatcatggattgcgtattcctcgtactgttcattcaagccgattttttctttcacatcttcctcgtcaataggaaaagtgaaccaagcaccgactaaatagccctcattgtatttgccaagattagcaatgtaaaccgccatatcatcaatcataagcaccacctcatttcttactctggcagttcaaagataccgtgttccgttactaaaaatttcccgtgttcctgcaagtgagaagcataggcttcaaagtcaaagtagtattcttgacagtcctcggataaatgtttgaacgtcgggtcgttcatcagcttttgccttgtaacatcaatcatgcttttacagtcgtgataaaccgtaatcacgttcctacaaatataaagtgcttctaagttctcaaacaccgtaagtagtgatacatattcttcctgcatatcacttgaaagctggcggtacataaaatctaattcattgagctggtacacgctggtgtgttcgtgaacttcatcagcaaaaggcaacaccttttcgataatgcggtaatccccactttctgcaccgacacctaacttttcttcaaactctgcaacatctatcggcaggtcgaaccagtatgatgttgtttcttcgccagttgttccgctcgtttccaccagcacccttgtttcctgcattgttcctcacgtcctttctgttgttttatcacatcttttatggtctggtatgacataccaaacacatagttagaaaaatcttctaactgtctttcttcatagtcggcagggttcagccgtttcatttcatgccacaccttacgcttgtaagagggcaggtcggaaatgtattcacagccgacgtttgcctgcatatccttaaaaatatcgttcatttcatcactccaatctgaaattttggcaagaaaaaagcagtcaatcctaagactaactgctttgtgtgtatagatataatttgattaagttttaaaaccagcttattttttcatctctaaattgagggttatcgctgtgctgatatggattgtagttattcaaattgcaaccatattcttttaatgatttgattttgttatcttctgtccattcaattaaggaaataccgtcaaattcttcaacatttcccgtattcatttcatttttaaaataccattctacgacagtttgattttctttatgaaagaactgtttaatatcccaaataatgactttaccacgggtattccattcattaaaccaatgttttactgtttttagattttcatatttaggacaccagctttccgtataaacaacatcttctgtaaaaattttatccattcctaaatcttgctgtttcagccacatatcaaaccataaacgaatgattttttctctctcactcataatagaacacctcaatccctaagactaaatgctttgtgtgtggatatgaaatcgtaaaactggaagttatctcttacttagaaaatagcatgaaaaaccataggaacaatgagaattaaaatcgcacctactacaaatacaacaattactttttgaaaacttcgtttttcttgttcagtcatatcattataccatttcatgagcgactacctccacaacttctaattcgtcactttcttcatatccatatcataacattatcatatcagcactgcaataaaattttatgcaccgataatcttattgaacagttctaacagtacatctttcacaccgccagcattgaatactaagccgacagcaatcaaggcaactaccaagaaaccgataagtttggaaaactcacgcttgaaccctaagtagataccgataactacaatcgccataagcactaagctctgtgcgtttgataaaaaccattgatataaattttgtccgaaattcatttaattgtcctcgctttcatttaattgtttcatttcacagtcagcttctttgccgacattcaaaatacacatcaagactatgccgatacccattcccatagataccagcaggaagtcttttactaattcccacatttttatcactcctaactttctactaaatcttttgcaggggtcgtctgctgtttgattatcatttcatgcttttctgtgagctttgcctgctgttcgattgtttccatgtagtctgtaccgtttcccttatcaatctttttcagcattttcaaggtcggtgctacctgcctttgtacccaacgcaatgtacggtctaaagtataaggctctggctttgtcgtcagcttcaagctctgtctgttatcgccgataaaccaagcccagcggtcattgagtttccagtcattttttcgcttgtctggttcttcatcaacaaaccgcacatactggttgatgatagaaaaggcggtctgctctgcgtcataataagtcagcaaatctcgtactgcataataggcacgttcattccgaagccgtatctcaaaacggttgataatgtcggcttcttccagaggtgtccccaacttgacgtactgctcatagtccttttcatagatacagaaatacacatcagatttcagcgaaccaagataaagggtacgccccatatattctctgtcgtcctctctgtgcttgataagctcgcccgactggtagaacttataacttctggactttccaatatattcccgtttcctgcatttttccgcaagctctggaatatccaaaatgcccgtatggtcgttgatagcaaggtcaatacgcttcatcacgcccccgtctacgagtgcgtccatgaggaagtcataccagcttctttgctgtgccagcaggtaactttcaaactgtctgcaaccacgcccctttaactctaaaaggacacctttttcttcgtcagccgacgtatagataaagatgtcccctaaagaataatgctccgtataactgtaatgtccgtaatcttcatggagcatataattgatattcagttttaatatgtctttgatgatatgctgtatatccagcgtgggaaaacgaatttttacataatcaaacagcatggtaagcggtgcttctggattgaaccttgccagttctttatgtagagtttccaaaagctcctttgacggcttcatttttccactttctatcttgttgagatattcccttgtgataccagaagccaccgccagcctgccttgtgagataccgtaagcaatccgtttctcccgtaattcttttatccattgttcttcattcagaaccatacccccaatctgtaaagtgtgaagttttttaaggcgacttcacagccgatttttactaggaaaccatgccagaagccttatgtttcctatgttttttgtctattgtctatttgcaaacgtacccctctgttagataccgaggggttttacctgctggcgtggcttacgccacaccagcaacggctagtccgtgccgtcacctttcgcttcgcacgtcgccgtcccgtcctgccttgcgttattcgattaccagcgtgaacgcttctggatcatcaacaatgttgtatgaaccgagcgtgtccgctgtctgtgtatatcggaaatgaaacaaaggcttttgtcctttcatggaaaaacgggaacggtacaccgtaccatataaagcgttgggctttgccacatcatagctgaacagagtagaagcaaaatcattctccctgcattttttgatgatttcctctgcacacttttctttatctgtaatgataagacggttgagcgtaaaggtaacgtgttcttcatggaaattttctgatgaagtccccatacttcctactacatcaatctcacgtccccattgcagataggaaaccgccactcccagcacaaaaagtaccgtgattgttattatttttctctttttgcacatactgttactgtcctttcttgtagggtgtattataatacagtctacgataatacatcttatttatcaatacagttgtatcttataattcaaagaaaagacgaggtacagcgtatgcaggtatatattgatttagaaaatcttttgaaagagaagaatatcagcaaaaacaaagtctgtgaagcgtgtaaattacagcggacacagcttaataactattgcaagaacaaagtttccagaattgaccttacaatccttgcaaagctctgtgattttctggaatgttccccaaacgacatattgaaattgaagtaggactgtcagctttcgttgcttgcagtccttttttcttccagcctgccgatttcttgtagaaaatcatgtcctttcgggactaaaggcgtgtaaaattcacttataacacttgttcccacatcacaatagccacgccccttgatacgcttctgaaaaaactgctttttcacatctgaaccgaacagcataccgtaacctaattcgctgatacgccccaatcccacacggaaattgaagttatctctgataccgtccgagaaatattttgcgtctggacgctgacaggcaacgataaggaaataacctgcttgtcgtcctaacatgacgattttctttaactggctaagtaggctcacgctttcttttgtccccagcatttcaaaaaatgccacatattcatcaaagataagaaagcagggtggcagtcccaaataggcgtagttttcgcccgtcttatagttcgggtgtcgcttcatttcctcgcttcgctgtaccatgccctcataaaaggcattgacgcaatcaatcatttcttctttggtgtgatacacatttcccataactgtccccaagtctgctaagtccgcatttttcgggtctaagacgtaaaggacagcgttggtatgcagtagggcttcaatgagcgtcagcagaaaataagttttaccgccacccgtcccaccagcgataagagcgtgagggagtgcgtcatattcccagacaaggtttttcatcagcctaagactgccgttttctgcccgtacttcatcaatggtaatacggttcgctatcatatcataaagcagggtatattcgatatagccgtcgtgcagggtcttgtcggtcagttcacaatacaagccactttccaatttatcctctaaccgtaaaagctggtcttgatatttccccagcgtaatttcacagcggatatgaagcagtcccttttccatttgataataaatctttggaaaccagacgattttttcccttgatctgctttgccggtcagtaaaaaaaccgctgtcttgtacggtatcggcttcataccacttattttccagtaccattcttgccagcttttgacggtgcaggagcttcttgaaactgtcgtaacagaagcggtaatatagaaaagcgaccaatgcacaaacacccgtcgctatcaatatggttatgaagttgtaaggggagagcgtcaagccgttttctaacaagctgaaatgctcccaatcagtacgcataagctgtttgatattgagtagcaaaagaaccgccacgaataccaccagaagcatccctatggaaaagtggtagacaaggtgcttgtcgctggctctgatacggtgtcctttattccaaatcttacgcataaatcaatcactcctttctgggtacgaaaaaagcagtcaatcctaagactaactgctttgtgtgtatggatatgaagttttgcaaatgggaattttatattacttttaatgcaatttctagtatcaacgaaaaaatacaaattgataaaataatgataactatttcaacatttcctagtgatataaaacattgaaaaatcagcataattcctactaataatatagctgttccctcaattcttgaatgtagctttatgttttttaccccattatatcttttgataaggggcaatttacctttgataatactgaatacccctaaaaccaccattatattacctagtattagccctatcatatttaccaccttttctaaatctttaattttcagttctataaatcgaaattttcttgtttaaatttatctttgaaaaagccaattaaaattaaagcaataccaagaattgcaactggtatataaataatattaggtatatgataaacaaatctatcaattccagacatagcaatataaataattattcccacacaaattaaaatgtttttatctttcatagctggtctcctttacaccttattatttgtccgtttcttcatacccatattataacagttccatatatccgctacaatgaaaatctattcagtaagcctattttttcggctgtccctgcggtgtatggttctgtggactgcctgcgttctgattgcctttatttttcaacacaatattctctgcctttacataccagtccacatctgcacccgtataagtctttcgtgataccgtatcggctactggattgacaagctccacaactgcattgtacggaaattcccttaacggtacttctggcggtacagacacggggataattccaccatgcagactgcacttcaaatcatagatacgctttttaagctgggtactcggtgtcccgtcctcattctgcaagaacacatcacgcaccgctgtaaattttaattctccaaatgttttctctttgtcaataacaaacccgtttgataatctcataaattcttcactcctttacttttcttcaactgctacaatatcatcagcaagcaacacataatcggtatgtcccatatccccgattgcgtaacctctgccatataacttcggattgacaagttttactttctgctcatacttgaacttcttttcgccagcctgcacgggaatttctaccacaacattttcgcctttctgtacgtcggaataaaggttatagcttcgtttggctaagactctgcgattatttttatctctttcaaagactggctcgctttcgcctgcaaattcaagagttccaaaagactgtgccatatctggcacgacatatttcatttccatattgttttacctcgtttctttctatatttgataagttttttaattgtgatttcttattctggcggtttgggaagtaccagcaatcccccagatagtaaagggtaaaatcaatgcttacgcacccttgactatccgtgttcttgcaggttgtaggcagacaagccagaataagcaaaaatctgccgtttgacagcttcggcggagagcgtgattttccttttctcataccgttaccgccttatgatttcttcattttacggcgtttgtaaagatatgttccagccagtccaccagcagacgcaagcaacatcacgataaatgccattacatttgtactgtcgcccgttttaggactgtcgctaggtctgttaggcttttccggtgtcggtggtgtttcgggtttctctggttcttctggctttttcttaaaggtaattgtctgtcccttatcctcaatatccttatgctcggtaactttcttcggctcgtctggattgcttaaatcgtacaattcttcaaaagttacaagctgtttgccgtcaagagaagtagcgtcaaacgtaaaagcagcttccactttcatagtttcgctgtcagcaataaaagtgtaatcactttccacacgttttccattgataagaagttctgcattttcttctttcaacatctgccagcccacaagtttgtactgtgtaccgacttctaagccctctaaggttacggtatcaatgattgtaacgtcttttcctgctttaagctctttgttgccgtccttatcggtagcggtagtatgtatcttgatgatacgctttgtgataagtaccgtttgcccgtcgtcctcaatgtctttgtgttctgcaacttttacgggttcgtctggattgctgaaatcatataattcttcaaaggtaacaaggtttttgccacctaaagcagacgcattgaatgtataggaaatttccactttcatttcttcatcatcagcgacaaaggtataatcgttttctacacatttcccgtcaatgataagctcggcgttttcttcctttaacatctgccagcctttcaactgatactttgtgccttttgtaagtccgtctagtttgaccgtatcaacgattgtaacctcttttcctgcaaggatagtcttttcgccgtctttgctggtcgctgtggtatggatagagatttctttttcgtattcgtcagtcaaagtccctaaatcaatcacaagattatttcttgctaccacgatttcaaaaggtgggataagttcaaagcctttgttactgttgcaacgcatttcttcaatgatgtaggtgtcataaggtaatgcacccttgctgtcgcctggttcagaagttccaaaccacacaccgtcctcactggtctttcctgcgtttgtattgtgcttatgagaagcccattcagcagaagtggagaattgcccgttatcatcagttaccactacatgattttcgcccgttgtcttgcttgtgatcctaaagggaacatcagcaagacgcttgtgtgtgcctgcaccgatttttacgccctcaatatctccacgcttaatctgattgtagatagaatgggctttgtcggttaagtccacgatttttccattttctgtgattgtaaaatcaatcggttttgcaccgtctgtcaaatatccatttggagcttcactttcaacgatacggaattttccataaggtaagaggtcagcagaagtagaagcgacaccctcaatatctgtacgaatagtttttacgacttcatttttcttgtatagcttgccctcaaccaagacagaattatcatttaaggaaatgatgtcaaagacagtatctttcagagtggcacttccttgtggctttgtatcgcccgtttctaaatctcgtttctgaattttgacaccgccacggataaccttgtctgatacggaaaactggttacttccagataatacggcaaggtcgccgtcctcggtaatctgtgttacatataagccttttatctgttcggacttatcgccagcctgcatatatgcaccgtctaacaagtagccgtttggagcttttgtttcctcaacggttagtgtcccaagtggaagaacggctttgccctcctgcatatagaagctgtcgccagacaccttgtatgcgtccgctaattttgtgatgtagtgagttgtcccgtcgctgtctgtttcagcgattgtctttgtaacccatgtacgattagcttcggcagggagattgtctttattatagaagccagcataatacttccatgtaaattccgcacctgctaaagaagcgttcccctgcggattgtctttctgtgtttccatatctattttgaaaagctcaatcaaagtgtctgttacttttggtgtatctgatactttcaaggttgctgtttcgccagctttgattgtcaatgaatagattgttttatccactttatatcctgctggtgcggataattccttgatatagactgtgccagccgttacctctgcaacatctgtatttccgttttcatcagtcgtaagggtggcaagctgtttcgtgcagtccttatcagaaaagacaccgtatgttgcaccagcaacagagtaattcccgttaccgtctgtaatgctggtattactggaagtcttttgcagtttcgcatttccaacattcagtttcgcccagaattgccctaattcctgcccctcgccagagtagatataaccgccacattcatagcgtcctttattctctttgacaaaggcttttgcaccagagaaaacttcgtcctgcgtagcctttggaatttcattataagaagctcgcacgttatcacattgccagccaagatgtacgctcaatctctgccagactacacattgttccaacagatagacttgtttgtagttcaattccttgtgagcttcgccatactgtttgacatactctaaggataacgccacatctgaaatctggtcggcactcatgcgtgagcttgcgtcagctctggtcttgtagccattcttaaaatctgtattgatgtcaatacaataggcagtttcgccctcgactttcatatagccctcattgaatgtcgaaccgatagaaccgtcattcattactttttcaatgataccgacacgctcggcactttctgtccagtattgcttgctttctgcatgaacgggtgtagtcggtaaagcagtaacgacagttgcaagagctaagaagcccgtacacaatcgtttccatgtctttttcataaatctaatgctcctttcattttgggtaaaaaaatagacgctcatttctgaacgtctacattactgaaaggcttgtcctctcacacatattctattttaataggtacaacagttgcctttctccttgtattttcgttgttttcatcacttgcgttatctacaacctccatggcccgggtctattacaataacagttgaattagtgtttttgccggtgttttttgcaagagcgcagacacctcttccgaggtagaaggacagaataaagagagctaaaataagacagtatttgtttttcttaataatgtacatatattttttcatataagatacctataaaaaacccgatgcacatagaaggcatcgggtgtgtttgtatattatatgattggctgatattatttataacctataaaaggtactgagttagacggtagctgttaaaggtacggcctctttcagtaagccttaagcaatcagttcagatatttgataacagtatcccagacagatgaattctcaaaaccaagcttccagaatgctgcaccggcgagcttattgtcgtcaacgagcttgagccttttctctaaagatgtagtgtcctcgagccataccttgtacagcttgttggatacagaccactcagcgtagttctgaccagattcctcatcaagagcagcagtggcattgtttgtggcaagctgtgctgcagctgcgtccatactatatacctgtgaggcaacagtgtactttgactgatcctcggtatcggttacggcatcatcgtcctccttaggagtgagctcccatattctggtataaaaaggcatgccgagaataatctggtcagcgggaacctccttcagagtggattcaacaccctcagttacccacggaatagaagaaactgagccggcatcagagcccttatagtgttcatcgtatcccataattacaatataatcggcaaagtttgccatatcagagcgattgaagaacttgttgaagctggcaggtactgtgacatcaactgaaagtgatataccgttattgtgacactttatggcgagctctctgataaactcaatgtaagagtctccatatgctgcttctgtgatattttcaaagtcaatatttacaccatcaagctcatagttaaatgcagccgacataatctgattgatcagggtagttctcgtggatgtatgtgtgagcacatatgctgcatctacatcagtattttcaaagttgctgaacagtccccatacctcgatgccctgggaatggcagtagctgacataatccttgcttgctatatctgccagattaccattgttgtcatttaaataaaaccaagttggtgacattacatttatgcccttggttgatgaaattacctggggcactttactgtttgctgactggcttgttacctgattccaggcaagacagatatccttatccttcttgatatgcgtaaaggtctcttcttcatagtcaggattcgtaagcttagtttttttgctctcggacagagccttgccctttatatatccaataacaccatcctcagtggcaatcttatcccatttgtcaccggaatcaagaatagtaaccttgtcatcctttttcacctcttttagaatagggctctttatgccgccctttacgcggacctgggtagacttgctgacagtggcactgtctatttcatcccatttgcttgtgatgacgatgcgtgccgggtcatcatatgacttaaaggtgatattggagtactgttttacatagtctaaagcgataagcgcagagtcagaggtggctttcacgatcggatagccaaagtcattggtctgcttggtgacactgtagctattgctgtcagccgcagctgagatgatatcagatgcggttgtgtaaagaagcacattctcatttgcatcccagtaaaatctggaatttaatgagtcgtgaacaaatttgtaatcaacgtatatttttttatctattattttagccttgtaatcggatagctcattatctataatgagagcagcctcatcatcagaagagatattgaaatactctttaagatcctctgtctttttcgtaggggtgtatttattgataagagcagttatacccattattattacaacgaggataataagtccggttactataagtgcaggcaataatttctttttcatgtgtaaaaatcctttcctatcatttggtgtcgaaattgcttaagctaattataccattgtgaaatagcatattcaaataatatgaaataaatttgtaataaattaagaaatttgtttatgcattttggcgcggaaggagcaaaagcttcccccgcgcacataccttttctttttaaaatatgtcttttggttgtctttttgcatttaaacggggtaaaggaccaaaaatatgctgacatcgatttcttgtataattgagaaaaaatgatattaatcattaattattgatagtttatagaaattgatatttccggagctttccacacccaatttaattgctgattttttagtttcgtttaatttgataaaatatctgtaaaaattccaatatataaatatagtttattcttctataaaaatacctccgtctatatataatgattatgagtaaaaactgataagtaacaaatggtcctatgtcatgaagcgctctgtggcattaaaagtataagccctccgaaggcttcggacataaaattgataaacagctggttaaagatgtcattttgcatcgtgatattaattcctttctgatatcttatccagagtgccaaacaggctggtattgatgaggaacgggtcctctaagtaaggaaagcctaccaccggatacttaaaatgtttatggttaattgtctttttcttttccacgagattaaacaatatttttacgctttctgaatcagttattttgtttgaattgaatagctcgataattctgttcaaagcgccccggttccatttacttattgtacacacagcgattcttacgtcacacctcataaattcttttaaggtgtttggattaagtatgccgaaatcaataatcacacgctcgtatctcatgtttaaaatctcagttagtgtggacatgactgcgtgaggaaagaaatctacattcttataagtaaaaaccttttcgtctgctgtctttgacagtgaaagaatttcgtgtgtaccattcagctcaacataggcggttctatacatgcatttattgctcatataattacaaagagcaaggcttatatgtgttgtgcctacattgtgaacgctgccacagaccccaactaactgtggtgcagaatggactttcttaaatatccttttaaagtgtctgatagtgatgctcctccctttagttctaacagcttttgaatcagcgtttcctttttaactgagctcttaaacatatcgctgtcataaggaaagtgataaacactgcaattaagtagtgccgcaatcgcggaggcatcctgtctgctgcacatattacatataacactcagggaagctgtcatttttttgagaatagaatgattcctgtagatatcattcagatgccaaaagctgccgttacatacatataatacgagatccatgtcatatattttctcgttgcacacatcagtgccaaggtcgtatatctgtatagcatcctttggaatattaaactgtataccgtcactgtagtcgggtatgccctgaaagcttttgtaataataatatccgtttttctgcttaaaaatctgcagtccgtcgtgattaccatggcaaagtacgctttttgctgagtctatgtagataccatgatatccaaggatattgagttcgcaggtgagtgaaacggccacgtgggtggagccgcagcctctgtgactgcctaaaactgctattttgtgtatgagatgtggctgaccggttaatttttgaatttcctgtatttcctgatatagctctgcgacagtcacgtaacgcagtgatgcatcagatgttgttgctttttggataatatgctgaaacttatgggaaaagctgtctggggtaaaggtcagtatatactgcagaagctgacctaagctgtaaatgtctgccgccggtgtaattgtatcttcggtaaagcattcgggggcagagaattctatattcccatagtgattgaagttatttccatcctggataacatatgccgatacgccaaaatcgataagcttaagcttattgtggcatactataatatgctccggtttaaggtccctgtaaataatgggagtagatatctgtgtatgcagatagataaaaacattgcataattgttcacaaatattaaaaaataaacctggggaaattaactgctgatgaagcaaaaatgaatctaatgtctcgccgtcgatatattcctcgacgatatagtaaaaagcattgtcctcttcgaagtcaaatatacgtggtatagacggatgctcaagagacttgagtagtcttgcttctgataatgcggattcggcgaaagcagaagctttaggaactttctttagagctctctcctgatccatagatatgtgtctgacaagcgtaacgctaccggagctgccggttccgagatctttaatcatctcatatttgtcaaacaaagaatgatttgtatttttcatacgctccttttgggtcgagcgcacatctcatggataacttataacatacctgtaaaataattgcaacactttttttatttttttttaataggcctcgcgctttacaatatgaccggtgtttattataatagttttacgatttacacggatattttcggaaaaggatgtgaaaaatatgaaaattgagaaggtaaatgataatcagatccgctgtactcttaccagagaggatcttgaggacagacatataaaaataagcgaactggcatatggatcagcgaaggcgaaaagcctttttaaagatatggtagagcaggccaattacgagtttggctttgaaacaaatgatattccactcatggtggaggcaattccactgccatcagagtctatagtgcttatcatcacaaaggttgaatatccggatgagcttgacaccagattttcaaagttttcagaggcagatgacgactttacggacttaggaaatgcaggacagcctccggtgataaagggagctgctgatattttggagctgtttgagcgtatcaagaaggaaaatgagaagacagctgatagtgagcagggaactgatgatattacagaagaacaggctgaggctgacgtagtcaagctgtttgtttttgataaatttgatgatgtgcgcaggatttcgcatgtgcttgacggcttttacagcggcagaaatgacttatacagggatgcttcaagcaataagtactatcttgtggctcacaagagtgagcatactccgaaggaattcaacaaagtgtgcaatattatttcagagtacgcatatcagaagaactatgtgcctgccaatgaagcatttttcaaggagcatggtaatgtgattattgaagaagctgccatccagacgctggcagtactttaacagaatattgattgcaaataaaagacggcctgcataagcaagccgtcttttcgtaaattaaccgaggtcgtgatcgatgaatgtgttgatttcaacgacaagatcatccgggtcaagtccgtgaaccatagcagcctcttcgattgtctccatctgtgatgatgggcatccgagacagtgcatgccgatatttaaaagtaatggtgccacgttctggtcaatctgaagaagatcaccaatcatagtgtccttagtaactctagccattattgtttcctcctattagtcttttaatgtgcctattataatacgatttgcatttaattgcaaattatactataaagattttttttgagtagttcgatatacttattagacaacggaatgttaatattacagcaaggatgcctgagaaattatcaggaaaggaaaacacatgaaaataaacaggaatatgagtgctgtcagggcaaataagcagctcctcggtacagaaaacagattatcaaagtctatgaaaaggctttcaagcggctacaagataaattcagctgaggacaatccggcaggaatggctatctccaacaagatgaaggcgcagatagaagcgcttgaccaggcaaaatcaaattcgtcagatgcgcagaatgtcatgaaaatagcagacggagcacttggtgaggtaagcagcatgctccagagaatcagggagcttgcggttcagggcgcttcagatacatattctgagaatgataaaaaggctttgcagtcagagatagatgagctcaccaaggaggtggaccgtatatcgggcgatacggagtacaatacaaagtcactgctcgatggttcgagtgatacacgcgtctatgtaaggcagaaggatgcaaatggcaatatgactcaggtgaacagctatattaccagaatcaatttctcagacaatgtggcgtcagataaatatgagctcacagtaaattcgcttgcaacacaggcaacaggaagtcttgcgtctgccacaaagcctgacgcagagggaacgatttccataaacggtgtgagtgtggctgtgaaggcagatatgactcaggatgagtatattcaggcgttgcagaaggcagcgaccacagccggtactactatgcaggtgaatggtgatagcatcagttttttatcaaatgagtatggcagcgacagcacagtaaatatatcactttcttcatcgcttaaggctctggcaggtgcaggctatgagaatgctgacgatggaagtggaaatatgcagctcaaaagtaatggtaaggatgccgtggttacaggcggagaaaatctgtcggacaagacaataagagccgacggtaaccgtgtatatgtggttggaaacagtggattttcaatggattttctactgagcagtgatatggatatgacagcgggaagcagcaatctgcagatagatatttcagatatcggaaatatggctgtacagattggtgcaaacgagggccaggagatgaaaatcaggataccggaggtatcatcgcagacactttatctggatacggtagatgtgactgtaaagggtggtgcagacaaggcaatgtccacacttgatgaggcgatagagtatgtctctggtgtgcggtcaaggataggagccttccaaaaccgtctggaatctgctgagagtagtctttctgagacttctgagaacatgaccggtgcatattccaatatcatggataccgacatggcaaccgagatgacggaatacgcagcacagaatattctcgaccaggccggaatctcagtgctgtctcaggcaaatgacctgccacagcaggtactttcactattgtcgaggtaataagcaatgaaaaatgaattgaagcaggagctcaccagaagactttgtgcgtgcaacaatggcggactcgtgcttgttatgtatgatatatattttggtttttcagatgatgtaaaaaatgccctcatgtcagaggacagggaagccttgagaaagggcgtgtcggatgtacaggcggcacttgatgagctgatgggggcacttgactttaagtatcctctcgcaggacagctttatccactgtactcatactgcaagaggcttttttccacagtgctttactcacttgatgtgtcggtggtggatgaggccgatgtcattatgaaaaagctcagaaacagctttgaaacagcagctgccgatgacaaatcggctccgcttatggacaatgcgcagaaggtctatgcgggcatgacctatggaaagggcaggctcacagagagctttataaacgatgataacaggggcttccttgcgtaggaggcctcttttttagttcattaaacctcattaagtcgcttggcacagtttaatagaaatttataccgcatggaaacagccttggcctgatagatgtagtagtcaattaaatcgggctcaaccacattttccaggttagtgtatacaatttgaagttcatctgttgttttcctgatgtcatcctgtaaggtcttgtaaccgtcatttacaggcgtttctttaaataatttcatgaattcctccaacaaaataagtcttaatacaagtataagcaaaagagtttcttctattcacagattttgtaaaaagtgcttttgacatgtgaaaaaccagtaaaatcaaggttttgactgtggattaatgtgttgggtttagctgcattttgtggataactaacaaaaagtatttatttttaaaaaagctatagacaaaatcgagagtgcgttgttataattcgtctcacgaaaggagaggtgatgaaaatacagtgattgtgaaattaatatcacacctcatgctgtatatactgcttacagtagcagcaattggggatttcaaaaattatagaatcagtaaccggctgattctgacgggacttggttgtgcgtttctatttcgcttagtggggggcaaggtagcgagcatcatctggtttcttccagatatagtttttccggttgtcattttatatttcttatatctttcaggcattttaggagccggggatatcaagttattttcagtagtatgtgcatttacaaatttaagatttaccgccttgtgcatggcagccgcttttgtggcggcagcgggatatggtctcataagtatggtgcttaaaaaggagctctttgtgcgtatgagggatggatttttatacttaaacggtatattgtgtggcagatttatgcggtaccgcggacaggggaaagctgttagtttcgcggtatacgtgcttttgggaacagccatggcagatatatggttttacggcatgaggtgatggaaggagggttaaagtaccatagatgaaaaaaatcagactaggaatttatattgaggattcagaatatggcgacagactgacatgctatttcatgaatcattataaggatcagctggagatacatatgtataccatgaaagagcagctggaacacttagagggcgagatagatatcatgctttcaagtgagcttgaccagtggaataacaagtatatcccactgatacagattgttgaggaaacacctattgagagtgaggagggtatatactttgtggaaaaatatcaggaagtaaaccgcatagtggaagagattttaaagcatgtgggcggtgaggtaagagacctgacgagtgagggctctttgataggtcagacgaggcttataagcgtgtattcacttgctgataatcagtaccagatgccttttgcgatgactttgtcctctattttgagtgagaatgaaaaggtactgcttatggattttcaggagaatagtggattatcgcggatgcttgagcagagtgtggagcataatctggacgagctattggtgatggccgaatccggacgatactcgaccaacaggataaacagctgtatcggaagaaagcataagctggattatgtatatccgattgaaaatacagagtgtctgtgtgaaataaatacggtaatatgcaacaatctgcttcagatgcttggcaaggaaatgcactatgactgcatagttcttaatatgggaacaagatttaagggcttttttgatattcttgacagatgcagtgatatctatctggtacagaaaaaaggcggaatcagccagtggagagagtacgagtttacagaggagctgattgaaagaggcttaagcaatgtagttgagaggattaagctgattgagcctccggtcatcacgacaccggtatctacatgtgataagcttgtggagctgtggaagtggaatgagtttggagatgtcataagaaacatgactcggggtatttcgtgtgctggatgattttggacagagaataagagatattatactttctgaaatggatttgtccagagagctgagtgatgaggaaatatgtgatttaatcggaagcgtggtttcaagagaggcacgcgacagaccaatgactataaaggatagagcggagcttgagcgcaccatattcaactctcttcgtaagcttgatgtgctgcaggagctggtggatgacagggatgtgactgaaattatggtaaacggtcccaatgatatattctatgaaaaagccggaagaatccaaaggttcaagggtcatttttcatcggaagagaagctggaggatgtgatacagcagattgtgggacgccataacagggttgtaaatcaggcatcaccgatagttgataccaggcttagtgacggctccagggtaaatatagtgctaaaccccatatctataggaggctcggctgtatcaatcagaaagtttccggagcatcctatgagcatggagaggcttgttgagatagaagctctctcgccggaggtggcaaggtttctacagatactgacgcaggccaaatacaatatatttatttccggtggtacaggctccggaaaaacgaccttcctgaatgctctgtcacaatatattcctgatgatgagagaattattacaattgaagactcagcggagctgcagcttctgggagctaaaaatatagtaaggcttgagacaagaaatgcaaataccgatggggttactccaattacaataagagatcttatcaggacggctcttcgtatgagaccggacaggataatagtgggcgagtgcagaggtgcagaggcgcttgacatgcttcaggctatgaatacaggacatgacggctcgttgtccaccggccatgccaattcaccacatgatatcatttcaagaattgagactatggtgcttcaaggtcaggatttcccactcaatgcgatacggcagcagatagcatccggaatagatatcattgtccagcttggcaggctgagggataaaagcaggagagtccttgagatatcagaggtggatggatttatggatggtgaaattgtgctgcatacgctgtatcattttgaggaaaccgctgttttggacagtgggaggatacagggttttttaaagaaagcagggacactttgtcacaccgacaagcttatggcagcagggcttagtgtataggctgttatgtggcatttaaagtaagaaaggctgtagctgtcagtataggaatatatgttactgaacagttatgaagggtttgattatatggattacagcagatattccatgtccacaaaggattgggggattgttttcataaaaagtatggctgccacagtgattatcgcatatttgttttatgacagtcctattgttgttattgcttttccggcggtgtttgcgtattgtgcaaagctgtgcaggcaggagggtgtcagaagacaaaaggaaaaactaaatgaagagtttatgaatgtacttaaggtattgagctcgaatatgctggccggatactctgtggagaatgcatggcaggaggctgaaaaagagatggagctcatgtatgggaatgattcgcttatgctgtctgagatacaggagatgaacaggcagataaagatgaatcagacatttgaggcggtgctgtcagaatttgctcatagaagcggtctggaggatatagtcaatttttctgatattttctcatttgcaaagagaagcggcggcagatttgtggatatcatagagtctaccacttacaggatgtggacaaagtatgataccaaccgacagatagaggttgcggtttctgccaaaagacttgagcaaaagactatgaactatattccgatatttcttttggcatttttaaagctgtcttcaagagattatatgtctgcactatatggaaacctgatcggggtaatctttatgagtacctgtcttttagcctatgcaggggcaattaaactggcaaagaaatttttacaggtaggaataggcatatgacgggaggaaagaggcttagaatagcagcattatttgttatagttttagtttttgcttttatcatggacatgtcgtcaaatgctataactgataatacacttatacgcaatgatacaggtgatggagatgcagtatatgacctggtgctaaatgcggatggactcgacgaggattacagctatcagctgaagctgaaggaggagcagccttcagataaacaggcgaacgagctgtttacacaggcaaaaaaagagatagacgacagcttttgcgaaaaaggccagagtgtagagcaggtcagaggacatataaatatgaaggatgcatatgcatcgggagctgtggaggcagagtggacactgagtgattatgatgtggttgatattaatggagatgtgaaccaggatgcatttgaggaggctgatgatgaacagggaaagctgattagcgcaagtgttgagctttcctgtggcgaacacagacagctgtatgatttctcatttgtggtatttccggatgaactggacgcgggcgagcgcctcataaagggtatcaacagacatattgacagtgagatgtcaaagacaggcactaaaaagctcacactgccggatgaagtagatggagtaaagcttagctggtcgcaggaaaaaagcaatacggcagctaaaatagccatgcttgaagttgttgttatagttcttctggtgcttgagaaaaaggaaaaaaagaagacggcgcagaaggagagaaatatacaactgcagctcgaatatccggagatagttagcaaaatggctgttttgatgggttcaggaatgactgtggagcaggcatggaataggattaccgcccgttatcttgatgagcggaaaaataatgataagaatattatgcccgcttacgaggaaatgcttgtgacggagagagaaatctcagatggcgtgacaggcagaaaagcatacgcaggttttgcggaaagagtaaagctgccatgctatcagaagcttgtacgcattattttacagagtattcacaaaggaagtaagggggtatgtgaaatgctcgagaaggaatcggaggatgcatttgatgagaggaggcttttagccttaaagcttggtgaagaggccggcaccaaaatgcttatgccgatgatgattatgatggctatagtcatagcaatagtaatagcacccgcaattattgattttaaaatatagaaaggaaaaattatgttaggatttaagaattttttattagatgaggatggcgcaggagtagtggaaatgatactgataattgtcgtgttaatcggtctggtgctgatttttaagaagcagcttacaacacttgtaaacaatatctttcagacaatctcaagagaggctggtaaagtgtgaaaggcagtataacggtatttgccacaatgcttctcatgctggtgtcacagtttctgtttactgtactggaagccggcaggaatctgacacttaccaatatagcatgcatgaattcagaggctgtagcagagtcagtttttgcacagtattgcagaccattgtgggatgaataccatctgttagcgtatgacgccggaagtgacgcaatgggcaatgtggatatcgaaaatgtcaagtcgtatatgaagcagcttacgactgacaattttaagataagcgattcaggagcttttgccgggggtactattgtaaacggcaccagtatgctaaggttgtcaatggatgagctcgaatccatgaaatatgtgctcatgacggatgatggtggtgatgtgtatacaaatgcggttgtctcgtatatgaagaaaaatattggttatgaaacagtcaaaaatctttacagtcagtatagctcattgaatgaaaacaagtctgcgggtgagtatgatgacagtaaaatagatagtgcgttaaaagccttaaaggataattcagctcatgaaggcggaggcaaaagcgtagcgaggtcgtcaccgccaagagcttacagtgctccttcatcggtttcgaaagcaaagcagacgtcagaaagtaaggcagaaagcacagaaggcggtaatgcaatagaaaatccgctggtcaaggtgcagaaagtaaaggcatcaggcatattatcgcaggtggttgatgagagcacggtgtcaggaaacagtattgatacatcagccagagtgtccgggcgaagtctgcataaaggaacagggggctggtccgaaagtagtgatgactggtatgcgaaagtacttatgcagcagtatattctgacatatatgagttgttacactgatacaaatcccaatcatgcccttaactatgaggtggagtacatcataggaggcagagcgagtgataaggataatctgaagatcgttatagctgaaatactggctctgcgtgcggctgccaatatggcatacctggcaggaagcgcatcaaagcaggcacaggcgatggctcttgctgcaattatcggtggaattactctgacaccggaggtaattgaaggggtggaaaagggaattctggcggcctgggcattctgtgaaagtgtgctggatttaagggcacttttggatggggataagattccactgataaaaagtgatacgtcatggacatcgagtctgtatggcatgacaagcatgctcacagggcaggtgaaggcaaaaagctcaaatgaaggaataggctacaaatcatatctgggtatgctgctttttacaaagagcatgaaaaatatagcgtatcgctcgatggatgtgcaggaggctacagtgcgtatgaccggtgcgcatgaaagctttaggatggacaatgcaatctgtgagcttagtacagatgtaagctacaaatatcatggcatatttttatgctttgtgaatctgttagatggggcagataacgagtataccattaaaaataaggcaaagtattcctattatggacgatgacgaaataagaaaggcaggtgtatgaaggtgtcttttgttaataaagtaaagttccacataaaaaaactttatagaaaggccaaactcccaggcgatgatagttctcaaaagatgccctcatgcacctgcctgaaagcgtcatatacacttgaggctgcggtaatatttccgcttgtagcaggcttttttgtatttatactttttttcttcagggtggttcaggtggagtcgcaggtgaaggctgctctgtattattcatccaggatgagtgcattagcgagcagtgcaaacgattcgtcagttgtatcagtggccactgcagaggtactattcaggagccaaatatctgattcgaagcacattgatacatacgtgagcggtggaaggtatggagtgtcactgcttggctcgagtatgggtggtgatgatgtctcgcttaaggcaaagtacaaggtaaagcttccggtgagcttttttactgtggacggaatatggatagaggattatagcaacagcagaaaatggacaggaaaaaatcccggcgaaaagacggacccatatgtattttacactgactatggcagtgtttatcacctgtccgagcagtgcaactacctggatttaagtataaagagcatcaaatggtcacaggtgggggcaagcagaaacaaagatggtaggaaataccacgcatgttactgtgccgaggataaaaaaacagaaggttcaacggtatttataacagattatggcatgaactatcacggaaagcttggatgcagtaagcttaagcggacagtacacaaggtgcataagtcggaggtagatggcaaaaatctgtgcagtaaatgtaaaggagaaggaacatgatacagcttatcattttacttggaataatcagtataattgacttttcaaccaaaaagataccggtagttgtattggtagtaatggggattgcaggtattgcaagctctttttatgcaaaacagtcaattatatcagtggctgttgccctgattcctggtatagtgcttatggcagctgcatttcttacaggagagcagataggctatggagatgctgctgttgtgacgcttatgggattgtttgtgacagctgacatagtgtgcagcactatggtgatgggactgacaatagcaggaataatctctgttattttaattgcattaggcagggctggaagaaagaagcagattgcatttacaccattcctactgcttggatatggactgacggaggtgtttatgtgactgaaaataaattaaatgtagatttatcttacggactaaaaggcagttatacagtagaaggagcgattattatacctatatttattgttatgcttgcgatagcgatgaagatgggacttgtgctgtataacgaaatgaaggaagacagctcttatgagtatgctactgatatgtggctggtggatgatttctataattatcaggttttgaaagaggttgtaaatgaattctaatgaaatagtatatgaaagaaagatgacaggcagctttatgaagctgcgttgtgacgaggtgaagccgttagatgaaaagatattgttgaaaaacaatattccgggctttctgaagatggagaagtgttatgtgaataatgaagggcagtactggtatgatatatccggagttcagtctttggaaatgcgctgccagtataatgatataaagcttgagtttcttgaaaagcttgtggtgagtatctgtaacaagatggagcttttggagaatcatcttgttagcacagaatctctggtgcttgatcctcagctaatacacataaaaggggtaaatcaggatgaggaaatatattttacagcatacccggcacagatgaaaacaatttgcaatacattttcgcatttgatggaatatatgctaacgaaacttgatcacagtgatgctgaagcgatacatatagcatatggcatatacgagaaaaccataaatggcaattacagtatcgctgatattcgaaatgccataatcgaggagcgacagaaaaaggtggcagaaaagccggtggaggaggtgattgcgccgatttcacagccacaggtcagagtagaggagcctaaggagcagataaagcctacactgtacgataagcttcgggtgtatctgctggagcagctggatatcaggctgccggagcgaaagaagcaggcgtcagtgatagaaaagcctaaaaaaccggacataaacagaaaatggtttaaaaaagaaaaacgaaaagaaaatcgtgaaaaggtagatgacaccatgcttatacacccaagctcagaggctgcaccggagcctgtaccgcgtcagatacaccccacagtatgtctgagcgattacagggagcacccacagggcatgcttttgtatgagggcatggaaaaccgcagtaatataataatagacaaagattgtacgcgtattggtcagggcgatgaggccgatgcggtaataggcaaggatacaataagtcattttcatgcagttataaatagggaaaaccaggaattttatctggaggatttaaactccacaaatgggacctttgtgaataatgaggtgcttgcgtacaagcagaagaagcagctcaagtcaaatgatattatcagatttgccgatgttaagtaccggtttgtataattgttgcaaataagctccttaaaaattataataagaagaaaagtatttaacaggaaaattaaggagatcccacagatttgcagaatataaaaagatttgatgataaaccatatatgataattggcataatagtggtaaatataatagtttttgtgctgatgagtatatcaggcagcacacttgatgcacagtatatggctgcccacggagccatgtaccctgagtatataaaggatggccagtactggaggctgttcacttcgatgtttatgcattttggattgatgcatatacttaacaatatggtggttttaggtgctgtcggtcagatagtcgagaaagccatggggcatgtgaagcttctgattacatttcttgtgtcaggcatgtgtggaagtgtattgtcatacatcgttatgctttataataatgactttgcggtatcggcaggtgcttccggggcgatatttggtctggtaggagcacttgtgtggatagttatagcaaacagaggcttttatgaaggaatcagcaggaagcaggctgtatttatggttatactgatgatatactacggagtttcaacgcagggagtggacaattgggctcatggaggcgggctcgtaggcggatttgttatttcaattgttttatatcgcaaaaagagatataataaataaaatatcaactaaaaattaatggtaggagaagctacatgaagataaatatttattatggtggaagaggcttactggatgacccgacgctgtatgtgataagcaggatagaaaatgtgctaaaggagctccgcgtaaaggtggagagatacaatatctatgagcacaaaaatgaaatagctacattgccacagaccttcagagatgtagatggaatcattctcgcaacgacggttgagtggcttggtataggtggatacatgcagcagttccttgatgcatgctggctctacggcgataaggaaaagataagcaatacatatatgcagcctattgttatgtctaccacatatggagagcgcgaggcagagaccacactatgcaatgcatgggagatacttggaggtctgccgtgctcagggttatgcggatatgtagaggatattactacgtttcagctcaataaggagtataatctcataatagaaaaacgcgcggagaatctgtatcgcacgatatcccagaagattaagagcctgcctacaagcaatcaggcagtgaagcaaagtgtactcaggacacagcagctcaatctcaccccacaggagagcgagcagctgtcgaagtatgtgtctgatgatacatatgtaaagcagcagaaggaggatatcgaggagcttgcaaccatgttcaaggacatgctcgggcagcaggcatctacagatgacatgccatatataaaggagcttgaagcacattttattccgcttcgtgaatttaaagcctgctattcatttaatatagagggcattaaaaatccattatatataaaggtggatgaggataagctggatatacactatggcgaagaggatatagtggatgtatacgccaaattttcgaagagtatcatggagtctataatagatggtcacatgaccttccagagagcatttatgaccggagaaatgacagcaaagggtaatttcaagacactgcgcatgcttgatcagatatttccgttttaatgggctttttgattcttaacagttacaaaataattatatatatgaggtgacaaagatgaaagatgacaactgtattttctgtaaactggcaaatggggatatcccgaccaattcaatctacgaggatgatgatttcaaggtaatactcgatgcaagtcctgctacaaagggacatgcacttatccttccaaagcagcattatgcaaatatttttgagattgaggatgagacacttgccaaggcagcaaagcttgcaaagaagattatgacacacgagaaagatgtgcttggctgtgaaggctacaacctggtacagaacaatggcgaggtggccggtcagacagtattccatttccatatgcacctgattccaagatatgagtcagatgacaacaaaaatgtcatagagtggaatcacaaggagttcactgatgacgagatgaagaaaatctgcgacgagatgagcatgtaatagctgctaatagttacacattatcgaaaaacaaaaagctcggatatgcaaatgtagttcatatccgggctttttcttttttataatatgcaatgacgctttaaacagactctgaccctatgacgatttcttcacctgagagttaatcaaatcaatgatagtggcgatggaatccatctgaccgctttttgccatggcatccttatatttatccctgttgccgtacacctcttttactgcgctaagcagagaatcctttgtgagctcctcctcctcgatgacatatgaaaagccctgctttttgaaggattttgcatttaatacctggtctccgcggctggcagcagcagaaagaggaatcaggatgtttggcttgtgcagagcaagcagctcgcagatggagttagctccggctcttgaaatagccatgtcagccagagcaaacatgtcggtgagttcagcattggcgtactcaaactgtgcatagcctgtgattccggcaagcttgttgtccagattgctctttccgcagaggtgaatcacatagaaatcctttagtagttcaggaagaatctcacggacagcttcattaacctttttagagccgaggcttcctccgatgataaggatgacaggcttattgtggtcaggaaaattacaaagctttatggcattttcggcaacgccgctaaaaagctcgcgtctgataggtgatccggtgagaacagccttgtctgcaggcagatatttcatggtctcagggaaattgcagcagacctttttggcaccctttatggcgattttattggcaagtcccggggtgatatccgactcgtggatgatggcaggcacatggcagtgctttgcggcaagcacgacaggtacggaaacgaagccacccttagaaaatactacatcaggcttgagttttttcatgaggcttacagcctgaccgtagccctttaacacgcggaacggatctgtaaagttcttccagtcaaagtatcggcgcagctttcctgatgaaatgccgtggtaaggaatcttttgggcttcgatcagtcccttctccattccgtttactgagccaatgtattcgatatcgtatccggcctccttaagtgccggcataagagcgatatttggagtgacatgacctgcagtaccgccgcctgtcataactattttcttcatatatatgtatcctttcttgtattcctgtttgtctcatatttatattatactcaacacaataaaagtcaataccaagttaccggtgaaagtttgccctgcaataccaaacaaatgtcgaaacttgcgaccgataggaactgttaagttcaagtgaattggttataataatcaatagtacatcatcctgcgttataggttaagttaaattttcaacgatgtatcggaaaaagaatagtagggaggacacattaatatggaattatcaatggacaatatggacatcatggcagggggcatacttgcgataatgcttgcacttttcatgctgacagtcattgtgaccttgttcgcactctcacacaggataagacttttgagcaacgaaatttataaaatagaaaaacaggtgagtgactacatagacgagctgtcgagaagcgaaagcgacaagcttgagatagagcataaggcacatcagaatggggtgatttcatcggtgctgcaggagatttttccatgaaatttgacaaaatgctattactgtgatattataccgactgtaacaaagttgtaacaaatgcaacataggtgtaataaacgtaacaaaaacaacatatactacaccatatggaggattatatgaagctaaacaaaaaagtaatcgatagcattacggtctgtggactgtgcgccatgctgacggttaccgcggttactaacagcggacgctctgaggtcaaagcagaggataaggtgctagcaaacactggtttagagcatactggttataatagttatgctggcgtggcagcgactctttttgattatgagaagggtctcacagcagagaatgctgttacagtagaaaaagaaaatgttgagatggtggcagcagcacaggatgcacagcaggaggtacagccacagctcacacaggagcagcaggaatggcagacaaagcttatgccaaaagttgaagaatcactcaacgtaagagcacaggccgatgaacagtcagatattgttggaaaactatataaaggaagtgtggcagacatcgtagaaaacgatggcacatgggctcacatcaagtcaggaaatgtagacggatatgtcaatgtatcttactgtgtgaccggaactgacgcactaagctatgcttacgacacatgcggagaaatcgccacagtaaatacagacggacttcgtgtgagagagacagccaatacagagagcaaggccttagaggtagctgaccagggcaagacctatcaggtggaccgcgcagcgcaggcaccggacggctggattgcagtagtcagcgattcacagacaggatatatcgcagcagattatgcgacacgttccctcaacacaagagtaggtatcacaattgaagaggaacaggctcagatagctgcacagaaagaggctgagagaaaggccgcagaagaaaaggcagcaaaagaagctgcaaaagcagcaaaggaatcaaagaaaacagagaccacacagggcgaggcggtaagtgcaggagcagatgacctgacacttcttgctgcaattatcgagtgcgaggcaggcggagagagctatgaatgtcagcttgcagtaggagcggcagtcatcaacagagtaaagagcggctcatatccaaacagcatctcaggtgttatttaccagaaaggccagtttggaccggcatcatcaggaaagctcgcaagaaagcttagcggacgcatttcttcttcatgctacagtgcagcacaggaggcaatgtccggagtggacaacacaggaggatgtacatccttcaatgaccatggctcaggaatatcaatcggaaatatgaagttcagataatatacagccaatacaaagaaataacaaagaggctgcaaatcaacaaagcttgttggtttgcagcctctttaattatttgtacggcgtggttttacagtcagagcgtcaatgcttcaaacctcttgcaacataccacaaaatagagtaaaatgacatcattatagcaacctacagatataaattatagcaacctgcatctataaacgatgcaaataaaacccaggaggcaagagcaatgcagttaaagggacgaaactttttaaaacttatggattacactccggaagagattacttatctgattgacctctcacaggagctgaaggaaaagaagaaaaaaggcatcagacatgatgaactcacaggcaagaatatagcgctgatttttgaaaagaccagtaccagaactcgctgctcttttgaggtagcggcacatgaccttggaatgcatgtcacataccttgacccgagcggttcacagataggcaaaaaggagagcatcgccgatacagcgcgcgtgctcggcagaatgtttgacggaatcgagtaccgtggatacggacaggaaatcgtggaggagctggctaaatacgcaggcgtaccggtatggaacggcctgacaaatgagttccatccgacacagatgatagcagatatgcttacaatccgtgagcacctcggcagactggggggcgtgaaatttgtatacatgggcgatgcaagatacaacatgggtaattcactcatggtcacatgtgcaaagcttggcatggacttcgtggcatgcacaaacaagaaatatttcccaaatgatgagcttgtaaaatactgtaaggacgttgcagaaacaaccggcgcatcaatcacactcacagaggatgtggcagagggcacaaaggacgcagatgtcatctacacagatgtgtgggtatcaatgggcgagccggaagaggtatgggcagagcgaattaacgacttaaagccatatcaggtaaatgaaaaagcatttgaaaatgcaaaggatagcgcaatctttatgcactgtctgcctgcattccatgatttaaagactactatcggcaagcaggtctatgagaagtttggattgagcgagcttgaggtgacagacgaggtatttgagtcagagcgctcagtggtatttgatgaggcagagaaccgtatgcactcaatcaaggctatcatgcgtgcaacacttgctgactagtacagcaagcaatgaccgcaacaaaagattgacggaaagctaaggaataaagtatgaaggaagaaatacttaggcttctacgcagcgctgacggctatatttcagggcaggagctatgcaaccggttcggagtatcgcgcacagccgtgtggaaggccataaaccagctaaaggaagccggatatgagatagaggcacaacagaataagggctacaggctcatggcagcgccggatctgatgacagaggcggagataaaaagcctaatgcacacagaatgggtggcaaaggaagtgctgtattttgatacaatagactccaccaacatcaaggctcaggagcttgccgaaaaaggctatccgagcggcacattagtcgtagcggacaagcaggagtcaggcaaggggcgccgtggccgcagctgggtatcgccgtccggcacaggtattttcatgacacttatgataaagcctgatatcaatccaaacaatgcatccatgctcacgcttgtggcagctcttgctgtcgcaaaggcaataacaagcgttaccggcgaggaagccctgataaagtggccaaacgacattgtggtaaacggcaaaaaggtgtgcggcatactcacagagatgaatgcgcagtttgactatatcaaccatattgttgtaggtatcggcatcaacgtgcacaatgagagctttccggaggaaatcagtcagatggcgagctcactcatgatagaagcaggtggcaaaagatttcaccgtgcgcagataatcgcagagaccatggcatactttgagcagtattatgacacatttttaaagacgcaggacctttcagccctcgtcagggagtatgatgagctgttggtcaacaggaacaaatcagtaagggtactggatccgaaggagccgtttgacggaaaagcgatgggcatcacgcctaagggcgagctgatcgtggacacatgggaatcgcgcaagctggtttcaagcggagaagtatcagtgagaggaatatacggatatgtctaaagaggtagtactttgcgtgtcaaacgcatatcagaaaaaatattatctgaacgagaattttaacggacttccacagactataagggacgagctcaaaatcatgtgcgtcctgtatacagaggatgtgggaggcatactggagttggtgtttgatgaggacggaaacctcgatttcagaacatcctgcaaggaaaatgactttttctatgacgagataggaagcgtgctaaagataaagcagtaccgcaacgagcgaagagagctgctcgagtcgatagagacgtattatcgcatagtatttttgggagaaggactcgaggaggaataacagatgattttagcgctggacgtaggaaatacaaacataacatgcggcgtgtttgatggtgacaggataaaagcaagctttagaattacaaccaaaatgccacgtacatcggatgaatacggcatgcttctgagcactctgcttgaaagaaatcaggtaggcatggacgacatacatgatgcaatcatatgctccgttgtaccgaatatcatgcattcactgcagaatggcctaataaaatacttcaatatcaggccgataatcgtggaggcgggtatcaaaacaggcatccgtatcgccacaccaaatccgcagcaaattggcgcagaccgtatagtagacgccgtagctgcatatgaattatatggaggacctgttttagtcatagattttggcacagcaaccacctacgatatggtcgatgaaaacggtaccttcatgggaggaatcacagcaccgggcatacgtatctcagccaaggcactctgggaggatgcggcaaagcttcctgagatagagattaaaaagcctgataatatcctcggaaaggacaccatcaccagcatgcaggcgggacttgtgtatggacagataggacagacagagtatatcattaacaaggtaaaggaagaaacaggcatgtacgatgcaaaggttgtagtaaccggcggactcggcagaataatatccaatgagacagaaaacgtggatgtatacgatccggatctgacattaaagggcataaacctcgtgtatcgcaagcagaaccgcaagggagtgaagtaatagtatggatattcatcagatacgaaagcttcagataggaagtgtgacactcccaaacaacctgatactgggacctatggcaggcgtgacagacctgccatttcgcttattgtgcaaggagcagggagccggccttttatgtatggaaatggtcagcgccaaggcaattttgtacaaaaacaaaaatacagagtcgcttctttcgatagatgaaagagaaaagcctgtttctctccagatgtttggctcagacccgcagataatggctcagatagcaaagcagatagaggaaagaccatttgacatactggatatcaacatgggctgtccggtgcccaaaatcgtaaacaacggtgagggctcagcgctcatgaaaaatccgattcttgcaggtcagattatagagagcatagtaaaagcgatagataagccggtcaccgtaaaaatacgaaagggcttcgatgatgagcatgtcaacgcagtagagctggcacatgtggctgaagaaagcggcgcaagcgcagtcgcagtgcacggcaggaccagagagcagtactactccggtaaagccgactgggacatcataaggcaggtaaaagaggctgtctcaataccagtcataggaaacggagacctgctttgtgcagaggatgtcataaaaatgcaggagcagacaggctgcgacggctttatgatagccaggggagcgcagggcaatccgtggattttctcacagatactgcattactttgagaccggcgagcatcaggaaaagccatcctttgaggaagtacgccggatgatactgcgccatgcacgcatgatgatagagttcaagggcgagtacacggggatacacgagatgagaaagcacacagcgtggtatacggcaggatatccacattcatcaaggctgcgcgcggcagtgaatacggtggagagcttagaacagcttgaggagcttttgtataaggaaaagcttaaaaattgaaatcggtcaaatccttgacagcgtggggattttcaattataatacacgcgttaaaataggctttacgatttaataaaacaaacttcccacatttagggtattttggttaccggccgagcatacagtttattcctcagaaaaatatgaagttagccacgggaacgaatcgcggatagagggtttttctttgctgcagggtttccgttgccgggggttatggaaacccgtggcagttcatattttgtcttcggaatatactgtatactttccggtatattaagtctttgaagtgggaagtttcattttagcaaatcaacataataaaataaaaggaagatagaagggtaagaatcatggataacaagaaaaatattctgacatatgcaggtcttaagaagctcgaggatgagcttgagcatttaaaggttgttaagcgtaaagaggtttcccagaagatcaaggaggctcgtgagcagggtgatttatctgagaatgctgagtatgatgcagctaaggatgagcagcgcgatatcgaggctcgtattgaggaaatcgagaaaatccttaaaaatgcagaggttgttgttgaggaggaggttgaccttgacaagatttctatcggatgtaagatccgcatcttagattgtgagtttgatgaggagcttgagtacaaaatcgttggttcaacagaggcaaacagcttaaagggcaagatttcaaatgagtcacctgtaggtaaagctcttcttggaaagaaagtcggagatactgtaactgttgagactcaggtaggagagctcacatacaaggtactcgagatccagagagcagaagagaactaaaagaggtaaaaaatggcaaatcagaataataacaagggtggacagcagcaggacgtaaaccagctccttaaggtccgtcgtgaaaaattacagaatttacaggaagcaggaaaggatcctttccagattacaaagtacaatgtcactcatcacagcagcgatgtaaaggagctttacaatgctcatgaggctgagattctcggtgacagaaaggctccggatgttgagggcttggatgacgctgcaaagcgagaggtaatcaacaatgattacaacgagagaagagaaatcatggatgcaaagccaatcgaggtaagcattgccggacgtatgatgttcaagcgtgtcatgggtaaggcttctttctgcaatattcaggacttaaagggcaatatccaggtatatgtggcaagggacaatgtcggagaagactcatacgcagacttcaagaaatcagacatcggtgatatctacggtgtaaagggcttcgctttcagaacaaagacaggcgaaatctcaatccatgcagaggagataacactcctttcaaaatcactccagatactcccggagaagttccatggactgacagacacagacaccagatatcgtcagagatatgtagaccttatcatgaatcaggagagcaaagaggtatttatcaagcgctcacagatactcaaggaaatccgtaacttccttgcaggccgtgatttcatggaggttgagacacctatgcttgtttcaaacgcaggtggtgccgcagcaagaccattcgagacacactacaacgcattgaacgaggatgtaaagcttcgtatttcccttgagctttacttaaagagacttatcgtcggaggacttgagcgagtatacgagatcggacgagttttccgtaacgagggcgtagacacacgtcacaaccctgagttcacacttatggagctttatcaggcatacacagactacgagggcatgatggagctgacagagtcaatgttccgttacctcgctgagaaggtatgcggttcgacaaaaatctcatacaacggcgtggaaatcgaccttggaaagccattcgcaagaatgacaatgatagacgcaatcaagaaatacgcaggcgtagactttgaccaggtacctgatgatgcagccgcaaagaagcttgcagacgagcatcatatcgagtacgaggagcgccacaagaagggtgacatcgtaaacctcttcttcgaggagtactgtgagaaagagcttatccagccaacatttatcatggatcacccaatcgagatatcacctctcacaaagaagaagccaagcgatcctacaaaggtagagcgtttcgagctgttttgtaatacatgggagatgtgtaacgcatactcagagctcaacgacccaatcgaccagcgtgagcgtttcgcagcacaggatgccaacgcagcagcaggcgatgacgaggcagagcacacagatgaggacttcctcaatgcacttgaaatcggtatgccgccaacaggtggaatcggatacggaatcgatcgtcttgtaatgcttctgacagatagccaggcaatcagggacgtattactgttcccgacaatgaagaccctggacccaaagaaggctgaaaacaaagccgaaaaagcagcggtaaatggttctgcagaggatgcaaccgtgtccgcgccaagcgtacagattgatctttccaaggtgaaaatcgagccgttgtttgcagatgatgtagactttgagacattcagcaagtctgatttcagagtggttaagatcgaagcctgtgaggcagtgccgaagtccaagaagctcctgaaattcacactgaatgacggaacagaccggaaacgcaccattttaagcggtattcacgagtattacgagccggaagagctggttggtaagacctgtgtggcaatcacaaacctgccgccgagaaagatgatgggtattgattccgagggtatgctgatttccgcagtgtacgagtatgacggacgggaaggcttaaatcttttgatgctggatgacagtattccggcaggagcaaagctgtactaaagaggtcatttactacaaaaaatcgcgttactacaacttttctacaacttttgcgcgagaccctacgaaaccggatgaagcaatatgaaaggcggatctgcttataaaatgcagattcgcctttctttttacatcagcttcatgttcacactaatgttttttgccttctcctgcatattctcttgtgtaatatgggtgtagatgtccattgtagtagagaaatcggcatgccccatgacttgctgaatgaatttaacatcgttggtgctttcgcagagccgggtacagaaggtgtgccgcaagttgtgaacactaaaatgagggagcagatccggttcacggtcttccagttcagcctgatccatttcctccatgttgtaagttacgctgattctctcaatcgcccgattgatattgtgggcgctcatgaatgagccggttcggttgcggaaaacaaaaccgtgaactcctcctaacaccagttgatcgtctggatacaatgcgtcgatggtttcaatctggaggcgaagctgctcggccacctctggatagaggatagggataattcgtgtaccgctctcagttttgggagtggtaatgtgaaatccggcttttccgtcaatgacccggtagattaagttgtggttgaccgagattgtgttttcgctcaagttaatatcgcttttggtaatgccggtacattctgctacacgcattcctgttccaaggagcacagtcatgatggggagccaatggctgtatgtaggggacttggcaataaaacgcaggaaattctgctgttgcgttttagtgagtgcgatccgccgtttaggctttggagcgctgccatccgtcttgagcttgcggtaaatgcccttgctgggatttttgcggatgtaatcgtcgtccacggccatttcaagcgtagggtgaacaatggtgttgatgctctccagtgagttgatagcaaagccgtgtttcagcagtttggtataaaacgcgagaatatcacttctgtggatttgtggcagaggcatgttagcgaaaggctcttctttcacatagaagtcccacaggtaaagataatttgctctggtagagggcttcagtttgatgttgttattcatgtagaccttgaacatatcattcagggtaagcttcatggcttcctgagtacggatgccatcatccttatctttgttgatctgcttttctttgacacgaagacttgcgagatcggagtcgtaaagatatttctttttagtgcctaatttgtagacatacatatagctgccatctgcccgttgtgtttctccaggccgaagatttcgtcctttgttgtcttttctcacttttgccattactggtacctcctgattataaaagtgtagtgcgccttactggcatggttatttagccggaaatatcataaagatattctttgatacgctggacactccataggacacgggtgttcatggtaatgcgtgcattggcaagatccccaatctgtactgcagtgtgccttccacagcacaacagtttgcaaagggtatcggtatcaacagccaagcactgctccggcggtaggtcattcggttttcttttctccataatcgtcctccttttttcgattacaatgatcccttacgatttgtagaagaaggttttcaacaaaaacaatgaaaacggtcttgaggtcaggaggtattgaaataacaaaagaactctaatggggccatttcctacgccagaacggttctgccgtgtatttcaggctgctgctgtgcagcacttcgattatgggcgcgcttctgtggtcatcgcacactgtccagaattcctgtataactccccatagaggttatgaacttgtcaaggtactaaaagagtgtagggatcatccggtattaccaaatgatccgatacatcctataaataggcagggaagaaagaacttctgcaaagaggaaagaaaatttaaagaaaatccaaaaatcaatatatagaatatttgaattgacaagcactatatattgtgttagaattgcaatgtaattgatttttgtgcgttgcccgtcagggtacacaggctttagggcttgtgttgcggagtaatgactgcattgcacacgctgttaattttgtacttgtgtcagtagtatcactgcgccttttcaggccggtatattgctggctttttttattttatgggatttacccaccattgcgagaatgacatcggttcataggcaactatgggcgccaggctttatgccgtctgtcattctcgcttttttattgcctgtaagcctgaaagggctttaaggataaatcaaaactgagaaaggcaggtcatgtacatgaatgtgaagcagaaaagaaagcagaatggtcggcgggtcaagccggcacattccacggactggaagatgaagagacaggcagtatcttcgctccggccccgaaatgttgcaccaatggcgagggcagttattttgccccgaagatcacgaagggggatttgatatgtccggcagcaatagtgctgaacgaaagcggcatgaaccgctggtgctggtagaaacggcagatatttcagaagaagactggctggattaccggcgccgtggaatcggcggcagcgatgtatcggcgatctttggcacttctccattccggacagccagggatctgtactacgacaaactgaacatagcgtcagtggaagatgatgagggcaactgggttgccatggaaatggggcatttgctggagcctctggtagcaaagatattcgagcggaaaaccggatatcgggtctaccaaatcaaaaagatgttccagcacccacagtatccttggatgctggctgatgtggactactttgtggaactgccggatggcaccacagcgatccttgagatcaagaccacaaactataatgccagagataactggtggatgaatgggaaggagactgttccagtctactatgaatctcaggggcgtcattatatggcagtaacggatcttgaccgatgtttcttttgctgcctgtatggtaacaacgaggaggaagttattatccgggaggtcaagcgtgatttcgagtatgaggctgagatggtctttttggagcagtatttctgggaaaaccatgtgcagcgccatgtgccgccgccctatacagaaagtggggccttgattattgagagcgcacgcaaacactttggcccggcagataaaaatgccccggccgttgcactcgacctggatatgactgcaaaactcatgcagtatttgcggcttctggatgaaaagaaaaatgcagaggtgtactccaaagaaatcgacaaggatattcagcgtctgaaggcgctgttgattgcggaaatgggtaccagctgtactgcagtctgtgagcaggagggagtgaactatacggttacctatacccctgttcgcaagtccatcatcgacaaggataacctgcttcggttgaaactggagcatccggatatttacgaacagtttgttacagtatccgaatccagacggttcagtgttagagcctcgattatggaggccgcttagtgaggtgaaaaaggatgaattgtattggtacctacgacgggacgattttttataatcctgccaataagttttgtatcgtcagtgtaaaaaccgcagaccagagcgtgccagctgaggccaggtcaaacaggcggtacaaagaccatttgatccgctttacagctgtggggtatgagattccacggacagatgcggtagagttggaactggatggggaatgggcaaaaggcaagtatggtgtccagctccaggtggagcagtggcgtgaaattgtgcccagaacaaaaaacggcgtagagggctatcttgcctccgggcttatcaaagggattggtcccaaaaccgccgcagacattgtggagcggttcggtgtggacacactggatattctggaacaccagccggagcggctgttggagatccggggcattacggaaaataaattggaggacatcaaagcttcttatgcagaaaaccgtatgctccaaggaattatgaccttgctggcaccgtttaagattactcccaagacggcattgaaaatatatcaatatttcggcccgaccagcgtagagattttggaaaagagcccatttgagctttgccagatctccggctttggatttcggcgggtagatgcaatcgtacaaaagagcgggggcaatctccatgaccctatgcgtatcaaaggggctgtcttttgtgcgctggatgagggcaagagtaaacgaggccatctgtacatcagttctgaagaactggagaaatcagcgctgaaactgctcaatgagaagatacctgtaccggagcttcgcctgcatcagcaggaagtcagggatatgatgcaggaaatgatcctgaatggagcaatcgtttccgtgaaggataatatctatcttcccagagtgtttgcccaagaggacgaaacggcgcgccggatcgcccagcgtctggtcgcccagatgccagtagagcatattgcgccggtactggaacaggtcaaggttgaaatgggactgcgcttgtctgcacagcaggaggctgcggtctatgcagcatttaggcatggcttgtcagtgattacgggttctcctggtactggtaaaacaacagtgctgcggacgatacttgaggtttaccggcggctgtaccctgatggcaaaattgctcttatggcacctaccggtcgggcaagccgcaggatgtcggagagtaccggctttgaggatgcccgaacattacacagtggtctgggactgaccagtgaagaggatgagggtagccggaacagaaagtcagagccactgtcggccgatttaatcattgtggatgagttttccatggtggatatgtggcttgctgagaaattttttgaacgcatgaagataaatgccagaatcgtgctggtaggcgacccagatcagcttccgagcgtaggagccggaaatgtgtttcgtgaaatcatcgaaaccaaaatcgtcccagtaacggtgctggatcagattttccgtcagtcgaaggatagtctgattgcctataatgccaaatttatcaacgagggcaataccaaactgttttacggaccggactttgttttcgtgtctggtgatagtcaggaagacaccgctgaaaagattacagaacggtattgtttggagatacaggagagtggcattgagaatgtgcagattctttcacctttccgttcagaaggcgccgcgtcgtcggaacagctgaatgagaccattcgtgaattggtcaacccattccgctctgcggaggaggaaatcaagtttggccccaagatattccggatcaatgaccgcatcatgcagaccaagaacacagaaaaggtatctaatggtgatttgggtttcatccggtatattaaggacactgaccagggcaaaaagatcggcatggattttggtgctggcaggacgctggaatatggcgtagatgatttgagcaatgtggatctggcttatgctactacgatccacaaggctatgggctctgagtatgaaacagtcattatgccgctgctcaaagcgcacactatcatgatgtatcgtaatctgctctacactggaatcacgcgcgctaaaaagcgggtggtgctgattgggcagaaacaggtattgtttatggcaatccatcgtaatgagattggaaagcgaaatacgctgctgggtatgcgtatccagatgtatttcaaagcctacgcaaagaaagccggtatccccattccagctgcattggaagaacaattgaagaacgcaagttaaaaaagagaggtcagatgcagaaatagcacttggcgtctcctatttttatgtcagaaaggagtttccaacatgaacgaaaaaagtaatccgatgcctatgatgtacaaaacaattccggcagtggcagaactgaacaaggtgccgggctttgacccgctcaaatttctgcgccataaggtgtccagaaagacaaatgaggaaatgctgcagttggaattgccttatcagaaactgtggttccgtctgcgccacccccagggccgcatgaaactgactaccctgcggatcacggaacagcttgcgattatggaggccagagtctatctggaccgcagtgatgcagagcccattagcagttacatctcgcagcacagtgcggaagaaggtaccgactatgtgcaggctgcccaggatgaggcattgagtgctgcgctgtcggatgccggttttggtctgcagtttgccgatgttgctgttgacagtacgggcaaggtgtttggaagcagtattccgctttccgggacagctcatatccagcaaccgatgccaaatgcggcgcagaggcccgtagaagcccctggagcggcgctgcggcaatctggtggggaagttcatgcccagctggagagaacgcctcagaacgccgtagagcgccgtaatgcgcctgctcgtccggcgcctattcagaaacctgcggcaaagccggttcagaatgaacagtccccggtttctccggtacagcccactgtccagcagatggctgcagaagagaaggagaatatggatacactgcctgccggcaaggtagaggagaatgctcccaatatggagctgccggtaccgagccgcgaggttacattggatagcagtccaaaacaggatgatgcgtctgagcagccggccgcctccgtattccaatcggatgaaccggaagaactgcctgtggcgcctgttgtccaacaggaagcacccgatcagcctgtggcgccttcttatacggagagcactccggtagaagacatcttgaaggtaatgacctttgaagaagcgcagaatgtggtggtggatagcggtctgagcaaaggaaagaccatggcaacagttgccaaggagcgtccggtgagtctgaaattctacctcaccccaggcaacaagagcaccaacaatatcgttcgtgctgcggcgcagatcatgctcgatggtatggccgcacagaaagccggatgataagcagccccatctatggggccaagaagggagggagaacagatggactcatatccaggagattttccgttcggtattatggatgtagtggaacttctacatctacgaatcagacgccgacaggcaaacagtgtatatgtggattgcccgttttgtggtgaccgccgcggcaagatgaatgtgaatttcgtcaaaaatgtctggcggtgcaattattgtgatgagcatggcggtatgcttgcgctttatgcgcggctaaacaatacgactacatccgatgcgtattgggagataggagaagccctgtgcaacgattttcacagggaacggccgaactctggatatgagatggcaggaaaccagcaggctggcactgggtccccggtttcggggactcagaccgaccttgccggatatgagaggaggggcgaactaaaaacagtgcagcaagcagaacgggccagcggacaggaaattcatcaaacgctttcgctgctgctcgctatgctgcctcttcagcctgcccaccgcaaccatctgcactccccaaaacggggactgtcggatgaacagatcgaccggattgggttcaagagcactccaccccctttcctttgccgctccattaccgagcggctgatgaaacagggatgcaaggtggagggggtgcccggcttttatctggatgacagcgggcgctggaccatgaacttctaccgaaaaaacgcagggattttgattccagctgtgggatacgacggtatgatacatggcctgcagatacttttggatagtccgctcaagcaaaaagatgatccaccggataagtcaggagccaaatacatctggttttcgtcctcgtccaaaaatatgggtgtcacatccgggagcccggtacattttatcggcaatccatctgctcgggtggtctatgtcattgagggactgctgaaagcagacatctcacactgcctgacaaaccggacttttgcggcgattgccggcgcaaacaacacaagccagttggatacgctgtttgcactgttggcacagaatggcactgaggagatcattgaggctcatgatatggataagtacagtaaccaaatgacctctaatggggcatctaagatctatctgatggcccgaaaaaatggaatggcatgtcgtcggctgacctggaatccgaattataaagggtttgatgattggcagcttgcccttcgggagaaagaacagagggaaaaggaggtgcagagaatgaattttaagcagcaatatctgtgcggtaagtgtgattttacttatatagatggctgcgtcgagctttggcacaccagagcggagaaagatttggacctgacagagtatctggggctgacaaaggaagagtatcagatatttcttgctcagggcaatcaggtgctgaaggatcttctggacagccagagagttttccggaggttttgcatttaccagctttgcctgggtgagacacagacggtacctttcgcgttcaagcaactggatgcactgcgtaaggctggatatgaacagccgcctgctgccgcctatcagacggtatggagcgcagaggtctgttgcccaaaggggcagaatgacatggaagtgctggggcgcctgttcctggactttaatgagcatttgccggaagattacagaggccgtccgttggctccatctgatgtggtggaactggactgccaaggcaaacgcacatacttctatgtgaatgactgccgggattttgcgccggtacgcttctccccattcttgtgtaaaagacttccggagcctgctcaaaaacaggaatgaagggataggggtcagatgcgtattgcagaaaagaagaaaagccagattacagcactgtatgagcagtgctccaatcttccggcagatgtcagaagttgtctggagaatggctactttaccgtaacggtacctccaccctggaacatgagcaatcaaaagactgcgcaggaggtgcaggacaaaatcaaggaatggtcaaggcagtatactggcgtggtctgctactgttttgacagcttcagcacacttttatatgtgctgtgagcaacacacaatggcatggaaagggtcataacggcctactccatgccattttttgcgaaaggagattttacaatgggtgttttttcagaaatagcaatggagcagcaaaacagtatgttcgattcgtctgcagcctttgaggatgatgaagcctttgagctggaggagatggaatctttgcctgtgccgcctgtaggtacagacactgtcccagtatcggcggcttcggtttctgccggtgagactgctttggctgatgcagaggaggaacctgcggatgaagtagcgcctgctggggaagagaagtctgctgaggaggggaattcggcacaaccgcccgccgcagaagatgaagaaaaaaagcgtgcggagcatgaggcggctgaagcccagcgcaaagcggaatttgacgccaaacagcaggcgaagaaagccgcggagcaggagcaaatcgcccgtctggaagcgatgagtgatgaagaagtaatcgcggcctctacccagagggtgagtaccgatgtagaaaaactgacacggcgaaatatgaaggaatgtgtgtccgagcatatccagatgctctgtatggaagatacggcgtttgcccgtctgacgatgcatccgaaaaagaacatgatccgctgtttccagtacatcaaccgaaaggcatgggattatgtgcaggatgagctaaaagcaagcggaacccgccctggtcccggacagcagacatatggctgcgatgtgccggatgatatgtgctatcagtgggcggaagattatttccgtgaccctgatgccaaggaagaccatgaggatgaggagaagtttgttcccaagccgtatgctgggaagtcctctgcaaagagcaaacccaagaaggcggcagagaagaaaaagacggaacccaaggcggcacccaagcaggaggaaaaaaagccttctcaggatgggcagatgtcgctgctggattttgggatggcaaaggcaggctgagccggcaaaggaggaaaaatgcagaatgattgcttataagggttttcgccccgggctgatatgccgtggctatcagtttgtgatggggctcaatacgactgaaaaagcaaattgcagggaaaatggatttcactgtgcggaaaatccgctcgactgccttagctattattccagcctggagcattcggaatattatattgtcaacgccggcggcgacatcgatgaagatgagcatgactccaaaatcgcctgtacggagttgactgtgattaagcggctaaccaaagaggagctgtttttacatggtttggcctacatggtagatcacccgcgcagggtgtggagttcccatgtggcagccaaccgggcaatggcgaactgcggttatgcggtggtacgggggaaagaccccgttgccaccggcagactgggagacatccttgcttttgcgaaggaagcgccgtattcggaaagtatcgtacaggttgctgtaggacaaattgatggtgtcacattactgccggatgtgtggtatggcgtggatttgacaagaaggacggtgaattgagatgaaaaaaagagccctgatggcacttcccaagctgacagcgacggatgagatgaagcagatcgcggcgtcagacttgccaagaaaagaaaaaatcgcctacggatatgttcaggaggtttgtgagtattatgtttacctgagatgcatcacgcaggatgggatattgaaggtggctttctttttcccagagcatcttcgcatagacgggaatagcccagcttacgaagtgtatctggataaagaaaagcggcaatttattacttataatagcctgaaccagaaatggtgtgaggccaaactggacagattggactggaagcgccgatactggtataccaaagcctactgggtcagcgaggaagatgagacatctatacaggcatatctgaacatcaataaaaaagcggtagaggcaatccggcagtttcagcggaatgtgcgtgaggaacagctcgaacagcggcaccggcgggaaactgatccatgggataaggatatggaacaggtgccggagcttcccaaggactggaaccgctgggtggataaggttgccatccggcaaaattacatttactaccactacaaaaagggcggcgccaaaacaggttactgtacctactgcgaaaaggaagtgccgatcaaggtgcatccccatcacaatcaacaaggccgctgtagctgctgccgacatccggtggtattcaaagcctatggacgagcggggtatatgcagacagaaaaacattttgcctacctaatccagcgatgcaaagacggttttgtagttcgtgaatttcaggctgaccggacatatgggaaagaaagccttccaaactccaagctttattgtcaggaaatccggcgcacgatttatgaccgggaaagaaaaccaagaacctactattggggtctgtataaacagcgaaatatgcgctggatttccggaagcccctgttcttatagttggtctggttcacatgatggacgggtctatggaaaaacgctgccaactctggaacagaaggaacttcgatgcacagggctggtcaactggattcggaagcagaaaagtgttgacccggaaaaatatctggcagtgcttgaacggataccgcaaatggagcagatcagcaaggtgaacctgccgaagcttaccaaggaatgtttcagttcctgcggaacagtcagtgaactaatcaaaaaccatagtgccgggagtctgattaaagctctgggccttgacagcaggaggtttcagcgacttcggctccataatggaggctgtgatctgctgcggtggctgcaatatgaaaagggcaccgacagggaaatcccagataatgtccttttgtggatgtgtcagcagaacattagccccagggatgtccagttcattgctgaccgcatgagcatggtgcaggtctataactatgtacggcgtcagatgccatccttccggagaaacagccatgaggtattgcgtacctgggaggattatctttccatggcaaagaaattgcacatggatgtatatgatgagatcgtatatcgcaccagaaaactgcggcggcgccacgatgatctggtgctcaaatgccaggagaaggatattgaactgcaggccgaggagatggaggagaaattcccccatgttaatgctatctgtcaggaaatcaaagcgaaatatgagtacgccgatgcggattacatggtagtggtgccagacggtattctggacattattaccgaggggcgtgcgctccatcactgtgcaggcagcagtgaccgctactgggaccggattgagcggcgagaaagctttgtgatgtttctgcgtaaaacggctgatcctttccatgcctattacacgctggaagtggagccagatggaacagtgcggcagaaacggacggaatatgaccggcagaagaaggacattgagcaggcgaccgagtttctgcagaagtggcagcgggtgattactgccaggctgacagaaagcgacaaggcgctggctgcggaaagcaggattcttcgtgagaaggagtttatccagttgaagaaggatcgggtcatcattcataccggccatttggcaggaaggcttttggcggatgtgctgatggctgacctgatggaaaacacggatagcatccagtctccggcattggctgctgcagcgtgacaaaatgagaatggccgggcgtccttgagggcgtccggtcattgatgaagaaggaaggagcagagcatgaaacaaattggaaatctggcagtggtttgcgccaggcgacaggatgtgctgctgcaggttggcagtgaaaaggtatgtgtccatgtgggagccgggccagagcggaatacgcttcacgcagcgtgggacgatgatgacgccattcagcgtattgtccatgaattgaattttggcagatatgcagccggcagaaatgggctgcataccgcacagcaggattgccctgtggggcggggaaaggagaaaagcgcatgatcaaaaacctgaatcagctgcgcaggacacttcgggaagggacgcagttggagatattggatcactgtcggccggaatgtattgggcagatacggaacattacgctggtaaacacgcagggcttttatagtaccgtagcgaatcagccagatgcgtctgccaacagaggcaacggcggccgcggcccgatcctttggtggggcagagccgcccactggcagtttgcagacggtgtttgcagtgttttcgacagtgaacagaagcatacggaagaagaactggttatgtccttccgggtacttgaaaaggaggcagcataatggaacggaatatttttgaaaagcagagagacttgaatgaccggctcaaccgttatcgggatgagtattataaccgcaacgctcccagtgtgtcagatgaggtctatgacagactctttgacgagttgaaagagctggaacaggaaacgggaatccaaatggcaaattcgccaacccagacagtaggctatcctgcggtgagcaggctggagaaaaccagacatgagatcccgctgctgtctttggataagactaagagcagtatggatcttctgaatttcatgggtgagcagcaggtgatgctgatgctcaaactggatggcctgactgtaaagctgacctatgagaatggagaacttctggaggcggctacccgtggcgatggtgacgaaggggagatcattacccataacacccgagccatcagcggtattccttcccacattacctacaaagagagactggttgtgacgggtgagggctttatcagacccagtgattttgaggaactgaagaccagcctgcaggacagcagcggtaagccctataaaaacggccgcaatctggctgccggttccatccgtctgatggatgccaagatatgccaggagcgtcggctggttttcatgccgtttggtgtgctggagggctttccgcacctgacccggaaatcagataagctacgggaactgcgcgcgttggggttccagccctgtaagtatctggtcacaaagcagaaactgacgctggaaaatgtggaagccggtatctatcagctgcggcaatatgccactgacaaagatatccccattgacggtatcgtggtttcgtttaacgacatcgcctatgcccagagctgcggccgcaccggacatcactataaggacggtctggcctataagtttgaagatgacctgcatgagagcctgctgcagtacatcgaatggacgccgggcagaactggagagattgctccggtagcagtgtttacgccggtggaaatcgatggctgtgaggtcagcagggccagtctgcacaacctgtcctttattgaggatctggaactgatggctggaaatcggattctggtaagcaaacgaaacatgatcattccccacgtggaagaaaatctggacagaggcggcttctctatggtggatacgattccccgtgtttgtccctgctgtggacagcctacccgcatccatgaatcaagtggaaagggcgaaaatggcgaggatcgcatcatcaagacgctgtactgtgataaccctgactgcgagacacgtcggctgaaaaagttcgtccattttgtcagccagaaggcaatggacattgaagggctgtcggaggctgcattggaaaaattcatcggtcagggatttatccatagttatctggatatttaccgtctggatcgttaccgggctgaaatcgtccgcatggatgggtttggtgaaaagtcctggcagcgcctttgggacgctatccaacagagccgaaacaccacctttgagcggtatctgatttctatggatattcctatgatcggcaacactgccagcaaggtattgggtcgtgtgttccactatgatttggatgagtttcgggatgcggtctatggcggctatgatttccggcagcttccggatttcggggagacattgcataacaatatccacgactggttctgtgtagaagataatttttgtatttgggaggagttacagactatgatgaatattcaaaagcctgctgtggtagaacacagcgaagacagggagcaggataatccctttgtgggaaagactatcgtagttaccggcaaggtggaaccctacacccgggacggaatcaatgacctgattgaatcactgggcgcctatgccggcagctcggtgtccaagaagacggattatctggtctgtggcgaaaatgccggcagcaagttatccaaggccagggatttgggcgttacggtgctgtcacctgcggagttcttcagcatggccggcgctgagtaagaaaatatagcatactatcggtatgctgtcagttgatcaatggggagagagccatgttgcggctctctccccatatcttttatggaagatttcaagtaggagggattttaatgcatatcgacaggataccggtttaccgggtatatcagagggctattgatttggagctttaccatgcctttgccgaattggtagtacagacttctcaggacgatacggcgagaaggacttaccgacaaacaagggcgatgcagatatggcaggtggaaacggatgtgtccggctattttgaaccatatcatctgcgttatcctggcgaggtgttggagcggtttgaggaaaaactgggcaatgatgtccgggttctccgcgctctggccctggcgctgggaaatacctgtgcgatccagtctgacaatatgtttgtgggcaatcagcggggagcattcctccagaaattgcggcggtctgccggagaagatgtgtacctgcagggcgctctgtatcttctggaaacagatgcggcacagcgccatgccctgttggagaaactggcagaaagggagtgtacgagaacggaagaagccctgtttgtactgtcgttatttgatgatagggaacgcggctatgaggtgatgcatacccaactcagtcatctattcacacaaaatctgacactttcactggtatatgattttggtgtgctggaatggttcatccggttctatgcagagcaggcaaagaggtaccgcgggaaagccgacctggtgctgcgcacgctgatgaaactgccgtatatgaatatgaagcccgacagccgcgaattttcggttttgactaaagcagggtatcgctgcgatgaaatcattttggcaaactctctcgctgtatgggcggacaggctgccggaccggttgagttccaagagtatcactgccgagaaaatcgcaacagcgtgtgggcggatgcttctgaatgctccaaaggatttttcggaagaattttacgagtatcttggctggctgtttcagttctataacagctttacggtcaagtacgaaggatttcagggactctgggaagcggttcaatatggtttgaaccccacagcaccgaaaacactgttatggatgaatcaaacgatacagaaggattttccgtaccgatttgatgtgtttgatcctcagtacgatgatctggcgaaggaactggagcgggataactatatggagttgtttaccctgcagatgctgcattccaggcagaggatccctttgaaacagtggctttccagatatcaggaactgaccggagctgactatggagaatatttcagaagttggcatacgaacggtaggcgggtatttgcctttctggtggaaaagaaggaaatcaatctatgggagtttttcaagcagcatcggcaagatggtgaagatgcgccacaactgaaactgctgcgggagtatgccctgagaatttcaagttggaggtgtttccggtttgtagagaggctactggctgagtacactttttcccaacttcaaacgatttttggcgagcggttttactttcacgaatgctttgtcaggagtgaggggtattacagcagaagggaatataaaacatacatcagccgtccattcctatctgcagagcagcatcggcagctctatgactgggtggagcgttcagttttccagactgagccggaaaaatatgaggacttcgttttaagtgccttaaaagcaccggagatccaacgcctttatgataaaaaagcgctggcagcggtgttgcggcagtttttgctccacagcgagtataacggctatgaaatcaaccggctgaaggaaacattctattccaaggaagagttggaagatgagcgcagagccgaagctgagagaaagaagcaggaaaaacgactggagcaggaaaaacggaccatacagaaacgggaaaagctgcagcaactttataacggcagcgccgaatctctggttaaattcattggaggatattatcatcaggacgagaagaacgaggtgctgaatatggcgtttgacaagctggtggaatggcctgtcggttgtgtacggacgatggaagccaaaggcgcacatgccttttttgaactgtgtggtgaactggtaaggtctgaaccccggccaaggcatgagattttgaatatggtgctgacaatgatcggaggtgaagcagcatgagaaatacattaaaacatctgaccctattgaccagaatgaaagatgacggattgctcccggcgcttacaggcagcttttcagaggatgccatagcgcaggcatgtggacaggtggagacacttcaattacaggaacggctgcacatccgaaagacaaagcggatacaggaagaactgattcgggtgccgaactttgcagcgctctatggtgtgttgtgcaggcaggagattggcgatgaagaaattgcttcagtcttagagtcggcagacgggtatggagagaaactgacagcgtatccccaagagcaggtgctggcagtcatgaaattggaactgttgccttccctgcggtttgaatacctgaaatactattttccctttgtgatgtatgaagaagaggagcaggtcatattggataacctgcagacttttcccattgcggagtggaagggactttccatgctgacggagcaccagcgggatatgatgcggcagccgtttcttggctcgtatctgtttttctggcatcaaaatgaacggaaagctctggaactgttggaacagaatcgtccgctccagagagtctgcatcttgctttatcggtatggtgtgcggctgtttctgtcagtagaacgcctgaaagatctccggtggatgaaaatgaccgatgtgggaaaattccgccggctgttggctgtatttgaatatgacgcagaggatttgtctgctttttttgacctctggctggacaaccatgccggacaatatgacctcaactggtttatctcccagccacatcctttgagcaaggaacggagggaagaaattttatgcaaccaactgagttatctgaatgctctgtatgccggcaggctccatctggattttaatgctgtccggcaattccagttttcaattctcatttatgcggtggagcatagaaaaaagcattttttggaattggtggatcagaacagtgaagtgttcctgtccttggggcgatactctctattgtttgagcagggcttttgtgagcactgtaacatcaattccctgacgctgaagaatttgaaagccagcgattctgtgaaccgcagcgacagcttttttacgcttctggaagaagggcagcagtacacctttgaggaaatgtatcagctttggcatcagaaagaggtttatgtccggttatacactatgctgacacctctttccatagatcagcgtttgctgacactgcggcagctgataaaacgggatctggtcagccagtatacaggagatgcagagttggagcagcttggaaaatgtctgctggaaaggccgtttagcgaatggtatcggggttcatttggacatatctgtgggctgacccggcggattgccatggggttgctgcaacactatatgcagctgcaggcattcataccggatttcactacagagtcggatgcggtatttgccctcaataatatgacggctcttctggaaatgacggattggaagcaggtgcggaaagatattctgacaacagatgcagactggctggatctaaaagaaaaactggcattttcagacgattttgtggagcagaaccgggagactgtcatggaatttttactgcagggcggcgcggctatggtatgcgctctctatggggaactggacgggcaggagctggctgttgaagcgctgcgacggattgtacaggctgaattgatgggccagttctataaactcaaatattttgccggtgacctgcagcgtgagattcgctaccctgtcagcgagatgcaggagagcctctggaagaaaaatctttcgttggcgcgaggtgcatttttggcaggggaggaggatgatttttaccacacgctgcagcttggcgaacttcctcatagtacctgtctgtcttaccgtactggaagccagagggagtgcctgttagctgccttcgactctaataagaagattgtccttgtgaaaaaggatgaagcggtggtggctcgtgcctgtctccgcttgacaaagggtgcatttcaaaaaccgcctgccgtcgatttttcttttgctgatctgtcgcaggagaacatggatatcggaaagcctgtcaccagtgagaagcctgtgctgttcctggagagcatctatactttcggactcaacgatattgaaaaagaggaagtaatgaaactggcagtttccctaacgacacagaaagcggcagagctgggtgttgtggcagtacttgcaagacggtatctgggctgctatgaacgggacgagtatgtgcttgcaccgttctatgtgtacatctcaaaatccaaaaacggatggcagtatctggactctctgggcggagcggcatatacctcagcaaaagaggagtatgtagagcatccattcctggtcatacagactgccatgcatcatgcaggagcacataacagaaacgaggtggattatgaataataggacaatggcaacagtttatgtggatcgggatagtatttccctcaagacccgttccagaagtggctgttcgccgcagcactttattattttgaaaaaggaattgcagcggctggaggagaaaaagtatttgatcaccaaagatatccattcctatgcagaactgcggctgtgtgatgccgtaggcggtgccaaagtgctggagctttccttcacatggctgaaggatgctggtagagacagcgtttccggttataccgagcgaataagactgccttatgagccattccgctcatatgcggcaggtgagggagaaaccgttgatagaacacggtggcggctgctgtccattccggaacagaaccggccaaagctggagtttcaaagccggaaaaatctcaaggctgtagtggagaatcctatcctgcggcacaaactggggaagtttctggaccagcattttaattggtacaactacgagcgcatcgtcctgacagatgattacttgccttacagcttcttttttgagggctacatggtacagggcacaaagacctgtggcggagtaatcctgcatggtgaagagaacatccgaacggcgaaatacgggatacatacttaacaggttaataggaacagagccgcaggtcagagatgatctgcggctctttatgtaagcataatcacaatagtcagcttgtattattcgaaataaagaactataatatgtcctatggaggtgcaaaatggactatatgacactaaaagatgccgccgagaaatggggcgtgacacctcgtagggtaaattattattgtgctggtgggcgtatccacggtgctgtgaaaatggctggtatttggctgatccctaaaactgcggagaagccgattgatgggcggacaagacaagggaaggagctgcgccatgaataaaattttgattatagatgatgacagagaactgtgcgctttgattaaacgcagcgtacaagcagaaaacatagaagctgatttttgtaataccggaaaagagggcttgcagaaattaaaagagcaggagtatcagcttgtagtgctggatgtgatgatgcccggtatggatggctttgaaacgctggaagaaatccgcaaagagaacagcctgccgattttgatgtttacatcccaaaatgacagcatttctaaagtgcggggcttacgggccggggcggacgattatctgacaaaaccgtttgatatggacgaactgattgcccgcattgcgtccctcattcgccgctacacccgttttaatcatcaagccggagctgtgcaaaaactggattttgacggattgcagattgaccttgaaaatcgttctgttacgacgggaaatggcacttttgaacttccaccaaaggaatttgatctgctcctgtactgtgcaaagcatcaaggtaaaattttgacaaaacagcagatttatgaggaagtttggggcgaagaatatttctatgatgacagcaatatcatggcgattatcagccggcttcgtaaaaaattagaagtcaatccttccggtccaaagtatatccagacggtcaaagggattggctaccgctttaataaggaggtgtagctggtatggaaatcatcgttttcttgtccattgtgattgctgttttggctgtgctgacatccatcgttctcgttcggcgcgtaaaaaaacaaatagcagaaatgaccgatgtgctggttgatgtgaaaaacggaaatggcaaccggcgtattctgtctgcaacaaatgaactgacagcacctcttgcctatgaaatcaatgagattgttgtgtcctatgaaagcagactttcaactgtacggcagacagaggaaaccaaccgccagcttatgacgagcctttcccatgatgtgcgaacgccccttaccactctgattgggtatcttgacgctgcacacaaaggactggtcacaggaaaagaccgggatgattatattgaaaccgcccgacggaaagcccatgatctgaaagaatatattgatgtgctctttgactggttcaagttaaattctaacgagtttgctttagaaattcagagcgttgaggccgcagagctgacaagaaatatcctgattgactggataccgatttttgaggataaacaggttgattatgacattgatattcccgaacagcctgtccgggtaagattggatatggacagctatatgaggatcgtcaacaatctcattcaaaatgtaatcgctcacagccatgcagacaaaatcaaaattgtcctgtcaaagaaggaaaataacatgaagctgctgctggcggataatggagtaggaattgagaaagacgatttgaaacacatatttgaacggctttataagtgtgataaaggacgctccgaaaaaggcagcggacttggtctttctattgtccatcagcttgtagaaaagatgggtggaagcataacagttgaaagcgtaccgggaaaagggactgaatttatgttgctttttccgttggagatttaagcgggttcccgtccttgtggcgggaacctttgtcatttttgtcggatttcaaattgcaaggttaatgcaaggttggcgtgatagaataccttacagaacaggaggttttgaatatggatacaaattacatcattgaaacaaaaaatttgacgaagcaatacggctcacaaaagagtgtggctgacttaaatatccatgtaaagcgcgggagaatttacggtctgctggggagaaacggagccggaaaaaccactactatgaaaatgctgttgggcttaacgaagccgacttccggagaggtcaaaatctggggaaagcccttgcaggggaatgaaaagaaattgctgccccgtattggcagcctgattgagtcccccggcttttatcccaatctgaccggcacagagaacctgcgtatctttgctactctgcggggcgtaccaaacaatcatgccattaaagacgctctggatctggtaggactgccctacaaagataaaaagctcttttcacagtattctcttggtatgaagcagcggcttgccatcgcccttgctgttatgcacgatccggaacttttaattttggatgagccgatcaacggtctcgatcccattggtattgcagaagtacgatcctttattcgggagctttgcgacgcaagaggaaaaaccattttgatttccagtcatattctttcggagatttccttgctggctgacgatattggaattatcgatcacggcgcattgctggaagaagaaagccttgctgagctggagcaaaaaagcagtaagcatatccggtttacactctctgatactgcgcaggcggcaagaattttggaacgaaatttccatgaaaaccatttttctatacaggacgaccacaatctgcgcctgcacaaccttgatctgcctgttgggaaaattgtaactgcctttgtggaaaacggattggaggtctcggaggcgcatacttgtgaagaaagtcttgaagattacttcaagcgtgtgacagggggcgaaggaattgcttaaactgattaaatgcgaattttggaaattaaagcggaaaagattattatacgcactgatgtcattatcgttattttttccgttgattttggcatatatggcaaaggcgggaacaggtgcagatacaacggaacattatcttcaaacccgatttgattatgtttatacaatgatgttgggatatggattggtttttttgcttccatgtctaattggtatcattgccgctattttgttttttatagaaagagattgcgatacttccaaaaaccttagaacaattcctgttacaaatacacaactcattatggcaaaaatttctatgctctttatttttagcattgcgttttgtctgacaagcacattatctgttgcgttgttttgtaaactgtttcatgtaggaatggtttatggtatgacttataagatatttatgagccttatttttggagttcttatcgtagcagcttctttgccgattgtatttttaattatttgttttaacaaaagttttttgctttctatcctgcttgcgtttttttattctatttttaactggggcatactagggacagttggaacatctataagtgctgcaaaaattgctttcttaaattctttcccagttatatgtgttatgaactggacaagcggcttaatgatggatcatttgcaaaaagacaatcttttgccggaagcctatgcgattgtaccaaccacttgccatacaatttttattatggcaattacagttatactttctttgtggctgatcattcgcttctacaaaaaatggacgaggtaaaagatatgagaaatattataaaaaccgaatttttaaaattaaagcgatattccgtaataaaagccggaattattatggcaacactttctccgttactgtcactgttttattctacagctaacggtggacagacatggacgtttgactattttatgcaacaggttatgattagtaactgtaccttgttttttccaattatcattgcattgatagcaggttatattataacaagggaatatacagacgatacgatgaagaatatatcaacaattcctattccatataaacagttactttctggaaaactacttgtcctattgttgttgacaatctgctttagccttataggatgcgtgctagcattagtaatcaatgttattgctggatttccaggagtgcattttggcaatctgctcaatatgtttattcgtgttactggggcgaatataggaatctatatttcagtcttgccgattattttgctattttgttgttcggcaaacaattttttgggtggggttgcgctagcttttgtgtatggatatttcgggacttttgaaggaacactgttaaattattatccgattaaagcaagcatgattttagtagaccctacttgtggcgcggaatatggttatacttatcacattttccctgcctttatcataatggttttgacattcttgatttctgtaattattcttgcaaataaaaagaaagacgctaggatattgactgttgctaagaagaaaaaaatagttagaaaaaagggatggtagaatagtattcagacaaagacaatagaaaaaataagtcattgcaggttctatatgttaaagtggagggatatatgggaaaaatctttgtactgtcggtaacagaccatgaagaatacatacttagcagaattatggagattattgcggccgagccaggatttgaccatactgtgtcatcccatccgtgtaatattcttgtttttccgggattggaactccgcctgaaggagagaacggtacatcgaaatggtgagttgatttctatgacccatcgggaatttgcgacattggtatacttggcaaaccatccatcctgggtattttctgctgggcagatctatgaagaagtgtgggggggagatagcgaaaactgtggaacggctgttgccagcgttattggtcagatccgcagaaaactgactccggatatgccgaaagcgggttatattcgtactgttctggggagcggatacaaatttgaagttccgcagggtatagcagaatagaggtttttttaattcaactgcaccatacccatgtaactacaaaaagattttatacatagtcagcaccgccgcaatcgtatcgtttgcggcggcgttttgttgtacaacataacattgaaactattgtatgtattcgcatttttgcccttgtgctgaaaagtaggctatcctataattaaaaagaaaaatatctgattaggacatttctgtaacatttggtgtttatcttattagtatagctgaaaaataaggaaggaagtgaaggtcttgaagaagattctaattgtagaggacgatcagcttttgaaccggaccttggcatataatctgacctctgatggatatgaggtcatttctgtttttaattttgacagcgcggtaagaaagctgcgcgaaaatgaatttgatgtggcactgttggatattaacctccccgatggcagcggactggatctgtgtgaagaaatccggaatcgcggtcagcatacctatatcatctttatcacagccaatgataaggagagcgatatgctcaagggatatgaagtcggcggtgcggattatgtgaccaaaccattttctgtgacggtgctttgcaaaaaagtagcggcggtttttgcaaatctggaactgcggacaccccggcatgatctgtttgatgatggctttctgaaaatcgacttttccgaacaaagtgcgtcccttgccggagagtccctggactttacaccgaaggaataccgcaccctgttcctgttcgtaaagaacccccggattattctgaccaagcggcagattttagagaagctgtgggacattgatggggactttgtggatgagcatacgctgacgacgatcatcagccgtatccgcaaaaaaatcgaaacagacgagaggaaatatattaagacagcttatggaatgggctatcagtggatcggcggtgagcctcgatgaagctgcaaaatttatctgtcagggcatttttgagaaaaattgtggcggggactctgctcactgccgctttgctgctgttgatttttttcctgttgacgaaagatgtgcgtgttgtcatctgcggcattattttgacagctgcatttttcatttggggcatggtttttctgcactattttcaaaagaaactttctctgttcaccgatggtttgtgccagacattggatcacatgatggacagtacagaccggccccaggtagactatgaagcggaaacactgctgtcccggatcagccaccgtttggaacggctctataatgtgatgcagaaaaccagacatacggcggaggtggaaaaggaagaactgcaatccctggtatcggatatttcccaccagaccaaaacccccatcgcaaatttgaagctaatcaacgatacgatgctgacaaggccattgacagaagaaaagcgcaaggagtttttgcaggccacaggcacacagctggataaactggattttctcattcagggaatggtgaaaacttcccggctggaaacgggtgtcattacgctggagaaacaagatgctgtgatcggggatacgctggtgagcgccatcaatggtgttttggctccgatggaacaaaaagagatcagcctgtcggtggactgcccatctgatctgacaatatcccatgacagccgctggacttccgaagcattgtttaacattctggataatgcggtaaagtacacctctgccggtggcagcatccaggtaagggtacgggattgggaaatgtatttgaggatagatgtgacggatacaggcagaggcatcccggaacattctcagggcacgatcttcaaacgcttctatcgggatgaagcggtgcatgatatagatggggtcggaatcggcttataccttgcccgtgagatcattaccatgcagggcggctatattaccgtcgagtctaaagttggggaaggatcaactttttccgtgttcctgcccataaaataattctgaggcagtctgttttggcaggctgccttttttgaaaaatttttagaggacaatggattttaggacaattctgcaacatttgggatttatgctgacagcaacatcatgaaattggaggtggccttatggaaatcacaaagacattactcatcaatgcagcttgcttgctgatcccgccggtcgttgttgttctgctgctccggcacttctttccaagaaaaatcagatggtcggctggtgtggtggctctggtagatctggtgatcttctggacagatattttttattatgagagcgtttggctgacgctgttttttgttgtaattcagttagcaatggttttgcttatatctatccggctttataaaaaaggcacacgaaaatgaattgtcctaaaattgaagcaattcacccttaaactgttgagcctttgggatatttctgcaacatttgggggttaggatgacagcgaaaggagtgaatggctatgacattaccgtttgaaaatgatacccgtatcattgtaaagaagttggcaaaacgaaacttaaaagcagataaaagtcgaaacatcctcattatcattacgattgccttagctacctgcttgataatgacaacgaccttgtatttttttgcttctcagcgaaaatcattaaatgatgcggctgggcgttatcaagcaattatcaatgaagtcgataatgataccattacgaaattagtaaatgacgatagggttcaagtgggggtaagtcatttattgggtttagtatcttatggggactacaaattaaccgttcgttcaatagatgaaatactaatgaaattagcaaaatatcctgatttagagggaaaattgcccaaatctacaaatgaaattgctatcacaaaggcgtttcttgatagagctggattgtccaaatccataggcgatactatatcgttaaatctgggagatggagaaaaagattataccttatgtggtattttgcctgtcgaaaattcaaattattccgtattcgtgtcgcagtcctatattgaaaacaagatcagcgaaccggcatactccgcttatatccgtttgaatgaatctgatggttggtctaaggctgctatacaagctgaattatcaacattgtgcagagaattggaaatacagccggagcaaatgcagttttcaacatattatttttctctcattgaacagagaagcagtcaatatatcactgtaatagcatttatcagtcttattatcgctttggcgtgtacccttgttatttacagtctgttctatgtgtccatagccagaaaaactaaagaatatggaaaactgcggacaataggggcaactggaaaacagatgaaaagaatcgtttttagagagggatttcatctttccagaattgctattccgattggaatattagccggtgcaatagcgggatatgtccttgtcccgcaaggctggaacactttaatggtatttgtaattgccgctgtcacagctctgtttgtgtatctatgcgttatgattgctgtaattaagccagccaaaattgctgctcatgttacgcctattgaagcagtccgttatatggcgggcaataatgatgtaatgtcaaacagtacaaaagtgttacatcgttctctatacgcgaaaaatttagcgttccttaattttgcgaggaacagaaagaaaaccgctttaacgatcctgtcgttaggggtatgtggaattttgctgatggcaagctctgcatattttaattccattgatcccttagcgatggcgcgtaggagttttccttacggagaaattcgccttgaattaggcgattacgggccgcaggcacataacagcgaacaatattcagaactccaaaaatcgaatctgcttacagaagattttagagaatccattttggacatagatggtgtggaagaaataaaagaataccaaggcaccgttttgaatgttcgtatgccaacgggagatattgaaccgattgtttcagacgcatatacgccaagctctcaaaaattgcttgaacaatatttgattgatggtacagcggatttgcaggaactacttaataataatggcattattattgaaaatggcccacagtggaaagaaacttttgggtgggatgccgcgattggggacgaacttctgattgaagttggcggacaaacattggaagtaaaagtaatgggaattgtggatgcgaatatcccgtatggcggatatgatacgctatttattcctttagaaatgctgtcaaagatcgttcctattgataacctcaattatcaatttattgtagatacagatgacagtaaatgggcagccgcaaaagatgaaatacaaaagataattccaccgacttccagcctctatgttagtaccttgaatgattgggtagaggcatacaacgaaaaactattgaactatcgtatgccagtctacatttttgttatgtttatcggggtttttggcattatcaatctgctaaacacactgataacaaacatcttgacacggaagcgagaattgggtgttttgcaagcggttggtttgagcagtaaacagctttcaaaaatgttattgatagagggtttgttctatacattaggggtgctgcttctttctatatcatgcggaacccttatcgggtatcttctctgcaccgtctttagtgcaatgagtatttttggaaaagtaagctatcattttccgacagttgaaatgttcagttattttatactgatgcttgccgtccaaatgcttttctcgtatttggcaattcggcagataaaaaaacaatctctggtagatcaaatacgggaattgtcataagaatttttgaaatgtccgagcattgtaacatttcgcggacattcatgatttacaattatgtcctcacctcaaataggaggcaaagaccatgaaaaaaacgatggtgatttcatttatagctgctgcgatgctattgataccatgtacagcttgtcatgtagcagagagccacaatgaagtactggcacaagaaaacaaagagaacactgttaacggaggatataccattacagatattactgaccccgttgaagttcaaagctacattgagcagcaaggcggtgaatatactgccgatattatggctgttcatcaggttacatttaccgattataccgcaaacgacattacagatccggcagaaatcaaagcctatctggaaagtcaggggcaagaatataacgagaatattaccgctattcatcagattactttcattgacggggaagcgacaccagagggttccctttgcgaagttgaaaaatgaattgtcctaaaattgaagcaattcaccatggatttttatagcgtttaggacaattctgcaacatttctcctttactctatatgcaacaaattaagaaaggcaggtaactgttatgaaaattttgcagacaacggatttgaaaaaatactacggcacagagccgaacattacccgcgccctggatggcgtgaacttctctgtggaggaaggcgaatttgtggcggtggtcggcacttccggttccggtaagtccaccctgcttcacatgatgggcggtctggacacacccacctccggcagcgtgatggtgcgggataaggagctggcgaagatgaacgatgagcagcttaccatcttccgccgccgcaatatcggctttatcttccagaactacaatctggtgccgatcctaaatgtccatgagaacatcgtcctgccggtggagctggatggggatacggtggatcagaaattcatggcggatgtggtgtccatgctgggactggaggataagctgaagaatatgccaaacaacctctccggcggccagcagcagcgtgtggctatcgcccgcgctctggtgtcaaagcccgctatcgtccttgccgatgaacccaccggaaacctggacagcaggaccagcgccgatgtgctggggcttttgcagagaacgagtcgtgaatttaaccagacgctggtaatgatcacacataatgatgccattgcccagcttgcagaccgtatcgtgcggattgaggatggcaaaatcgttggataaaggaggtggcagacatgacattgccttttgaaaatgatacagggccggttattaaaaaattggcgtcacgaagtattcagacagataagcggcgcaacctgtttgtgatcgtaacgattgctctggcagccgctttgatggcagcgattttttgtgcaggagcgggaagtgacagaaaactggaggcggacattcggggacagtatcaggcggttgtggtgaattgtgaccatgatacgattgaaagactgaaagactgcccggaagtggaacgctggggcctttcccagaattacggttctgcccgctatggtgacagcgttctgactgtggagtatgcggatgccaactggatggaattgggtaagaagccttcctttactgggacacttccgcaggctgccaatgaaattctggtagaacgggcatttcttgattattttgaaatccccgcagaagtcgggcagaccatagaagtgaatcttggaaacggaaagcagacctataccgtcagcggtatcatggatgtggagaatgactcccgtatgttccagctttatgtatctgaagcatttgtggaggagatagcgcagggagagccgctgtttgaatttcggcttcgttatactggtgctgatagtatggagctggagcagctcaaggcggatattgcagcattcctttctgccaacgatgtctcagaggatcagattttttacagttccaactatttcgatatgcagggctttaagtccggcgtgatgaaatattacattcccgtggcaatccttttgctgattgcctgtgccgtggtcatttacagtatctttttcatttccgtaaagggcaaaatgcgggaatatggacgcctgaaagtgattggcacaacaccaaaacagatccggcggatcgtgcggcgggagggattgctgttatctctttgcggtatcccgctggggcttttggttggaggggccatcgggtttgccattttcccggcacattggagctggatgggcaatctgccctatctggctgcgaccgcagcagcctgcgccctgacggtatttctgtccattcatgcgcctgtccgcatggcggcgagggtatccccaatcgaagcggtccgctccagtggttatgaaacggcaacagaccgcaaagatcagaaaaaccaccgcattacgccgttctctatggcacagatgaactttaggcggagcaggaaaaagacggtcatcactctggtatctttgggattgacgggtgtgtttctggtaacagccgctacggtacttaactccatcagtcccgaaaagatggcgatagaagctatgggagatcactgcaactatgaggtcagctggatggattcgggaggcgcggaaggattgcctgccatcgcacgggaaaatccactgacagaagaacttcgtcaggaacttcttgccatagatggtgtggaatctatcaccagccatgaagtaacatccgcaacggtgaaattcccccaggaaagtgttgcattaaagttccctgtatttgacagagagcagatggaacaatggctgccggaggaaaatctggaacagggcagcgcagattatgaggagcttgccgcaaacaacggtgtggtcgtgacagattcggaagatcatcttttaagtatgttttatggctatacgcctgctgtcggggatgtgctgacctttgaatccatggatggtaaggccatagaagtaacggtcatggggattgcgaaaccgtcagtaacatcaggcaccggcgcatggggcctgtttacccttacagaagaactggccgatcagctctacccggacattgagaacagagaggctgtttggaatgtccatacatcgaaggactcggatgcgctcagggcgtctattttcagcctgctggaaaatccggtgctgacggtcttttccagagcagaccacgcggcctccctggaatcgcagctaaagatgatgacccgcggggtttatctgctgctggcgttcctgtttgtgttctctatggtaaatctggtcaacaccctgatgaccaatctgctggcaaggcagcaggagcttgggattttgcagtctgtgggcatgagcggaaagcaggtttcccgtatgctgattgcagaatgcctgtggtacgcgggggttacggtatttttgtcggttggcattggcggaatcctgggctggatttttgactatgtgatcagcagttttaatatttttggggaactgtcctatcaattccctttgatggaaacggttgtttttgttctggcacttttggtcgtgaccggaatcttctctgtggttgcggtccgttactctaaacggctttcccttgtagagcggatcaagaccatggactaaccagaggcggcggcttccgatatgaagccgccgctttgttgacagcagaaatataagacttaaaggagatgatcaaaatgacagtaccatttgaaaatgatacaggaaatattgtcaggaaactggcaagaaaaagtttgaaaagtgagaagcgtcggaatctcatggtggtgatcgccgttgcgctggcatcctgtctgatttgtttttcgattgtgatggctttgtctacccggcagatagagaaaaatcatgtggaggatacctatgaggcggtctacacgaaaattaccgaggaagatgtgtcctccctgaaggggctggatgacttctcgagggtaggagagtattatatgctggctgtggaacctgcggagcagggatacaatgcctcctatatctattgtgatgaggaaacgatgtatattgcccgtgaccagatgaagctgctggaaggccgactgccccaaaaggaggatgaggtggtggtgagccgttatttcctttccaactatgctgcagacgccgggattggcgaaaaggttatgctaagcagcgagagctttcacggagaatacacggtgactggcattatggaaggctataaggaaaaagaggtaaatggatcttccatccttctttccaaagaagccctgaaaggatggagcggctatgaccccgctgattatcgagcctatgtgcattttaagaatgagcagcaaatggatgaaacagagctgactgcccgcagcagggagattgccaaggaatatcagctggaaatgccgatcatgaacctcagctatatgaagttctataagcagcctgtgaatgtcagtatgctggcgctggttgccggaattgcagttctggtcatcatcggagggtatgttgtgatacaaagtatcttccgaatttctatcaatgataaaatccaaagctatggacaactgcggaccatcggcacaacgccaaaacagatccgccgtattgtcaaaaaagaaggccgtttcttaggatgggctggcattggtatcggtattttgctgggatgtgcagccgggtttgcactgtttccccgtgggtttaatctgctattttatgcagccgcgattgttttgactgcactgcttggctggtttatggtatccattgcgatccgcagaccggtaaagattgccgccagtatctccccgattgaagcagtccgctttaccggcaatcagagcggaaaggcccacacacataagaagaatatgcggttaaatcccctctccatgggaattgcaaatttcaggcgtgaccgcaaaaagacgatcagtatcgtggcttccctgagtctgggcggggtgatccttttggtgacagcttctattcttttggttcgttcgccggagcggatcgcaagacagtatttcccggatggggattataaaatctatatccattctgaaaaaacagaatatgaggtgatgtcaaaaggaaatcctttgaatgaagcgcttcggcaggaggtgctggccgtggatggcgtaacagatgtgatagaaaatcgtcaggcggttcatgtgcggtttgaaaatgaggaaagttcttccggcggaatgtgtgatctgttgagtgaccgaaacagggatcaaatggaagcggcgcttgtgtccggaactttacctcaagattcccatagtattgcacttgatatggattatgcagaagatatgatcggtgtagatgtggggtcagttatcaaacttaccataggggatcaagagattcctgtcactgtttccggtctgctcataaacgatgggcttaaaaatggtcatggtcctctggcattggacagcacctgcatggttgcaaccaaagagctatttcaggaagcaatgccaaagatcaactgttttgattattcctggagcattgtcagcgatcccaaaaaggcggagcagattgaaaacagtctgagtgcgatcatttcttccaatccggatcttgacttggataccattgggatacataaggattatgaggaaatggaaaaccgggtcgtttttggagggtttcaggcgctgtcctggctggtattcctctttggcgtggtcaatctcatcaacacaaccctctccaatcagatgtccagaaagagggaaaacagcgtctttcgtgccatcggtctgaccagaaaacagctctgtcaaatgaccatctatgagggaatttgctatgcgttttctgctgcgttggcgaccctggcagtcggcctcccgattgcaataatagctgcccgaaaattcagcgaaatgacttttcatgtagcaatgccctattccttccccttcctgcaaatggggctgttcgttctggtgctgtttggcctggaggtgattctgtccttctggacaatgcgcagacagaaaaatcaatcgctggtggaagaaatgcgagcgatggaataagcatataggatcggcggggcggcgtgtgctgccccgctttttaagtttgctgttatattttggatcgttattgacttctattacggttagtgatatatttattacagtaaccgtaataaggaggcaggtgttatgcgagacaatgcgaaaggcggtgcgctcacagaggtgacattctttattttgctttccctttataccccgaaacatggatatgctgtcatgcaatttattgaagataatacaaaagggcggcttgcgctgggggcaggtactttatatggtgcgttgaactcgttgcaggaaaaaggctggattgcaccttttggagatagtgcgggacggaaaaaagaatatctcattacaacgcaaggaaaagaaattgcagaaaaggaactgataaggctcaatgaacttgtaggcgtagctaatgaaattattggaggtgcagtatgagcaaaaagtattatcgtttctttggcggtttgttgactgcccaggaacattggctgaataaaatgtctgaaaagggctatcgtctgattcgggcggaaaaaatgttgtatgaatttgaggcgtgtaaaccggatcaggtaaaatactgcgtggagtttatcgggcaaaaatcgaaggccaacgcatccgattatcatgagtttttagaggggatgggttacaaagtattttataaaaacatcaacctgaactactctgttggtaaagtacgcctacggccatgggctgaaaaaggcggacgcatagcaacaaatgccaccacctttaatcgggaactgttgatcgtagaaaaagataatgacggtaagccgtttgaacttcatacttcttatgaggacaaggaaaactattacagaaatctgcgaaatccgtggttgctgatattgctcatgttcgcaatatttgcggttgcaaaatgttcggtagtttttggtgtgcttgccctggtttctctgattcctgttctcgtatatcaaacccaggttatgcagaacaaacgcgaaggtaagacaaaagaatggtgaggtgtttatatcatgaatgaacgagaaaaaacaatccgattatggtttgatatgtggctcaatcagcaggatatggggattgatgatatttttacagaagatgtgatctatacagaaagctggagtccccagtataacaaccgaaaaacagtaaagcattggtttcaggaatggaatacccgtggcaaggtggttatttgggaaatcaagcaattttttcataagggagatcaaacgattgtggagtggtatttcaaaaatgaaatgaacaatggaagtatagaggaatttgatggaatctcgctggttgaatggacagaggataatagaataaaggcgttaaaagaatttgggtgtaatcgcaatacctataatccataccaggaaggcggtactcctcaattcaaagcagaaaaagcgaattggttttgaattgagtgcttatggaggtaaaaatatgatgtatcggacagaattagtagaaggaattaccgtggaaaatgtaacagagaaaatcaatgcaaaaatagaagaaatggaaaaggaaagctatcgacttgttacgatgtctttttggggaaccgaaagagctgtactggttttcaaaaaagggttaaagggtagtttgctttaacacatagtttgcttttgaactgtcgtctatggtgcgttgacagactggtaatctcgactattcgttaaaggactttattgtggactgttcgagcaagccattgggctttgaggtgacaaatatgaaagtattggttagtgcttgtattatgggagagaactgtaaatataatgggaaaaacaacaaaaattcagcagctatccattttttaaaagataaagaagtgatttctatctgcccggaagtattagcaggaatggaaactcccagaccctgcgcagaaattgtgaatgggagagtagttgatgaaaacggaaatgatgttagtttagaatataataaggcagtggcagttgcattatcgaaaattcagaatgaagagattgatttagttatattacaatccagaagccctacctgtggtgttaatcagatatatgatggtagcttcactggaaagttagtttctggaatgggtttgtttgcaaaggcattaaaacaaaaaggatatcatgtcattgatgttgaagaaatataagtttaccatttttcatttgttgagggataaggttcctaacgcattaaggctgcatttttatattcgcctgatgcaaatgtcaatgggagcatgagcgactatatcatagaatattatttttttcacggaggctgatatgaaagaaaaaatattgataatagaagatgatccgttgatacggaatgaattgaaaacgctgctgcaaagcaatggctatgaagcggcggctccggaagatttttctgatgtgattgatcggatcaaagccgaacagccacacttgattttgctggacatcaaactgccggggaccagtggcttttctctctgcaccgagattcgcacattttccgaagtgccaatcatctttgtgacaagctgcaacacggatatggacgagctgaatagcatcatgctgggtggagacgcttttatcacgaagccctataacacagcaatcctgcttgcgaaaattgcttctctgctgaagaaagcctatcccgcacagcaacgggagcagatcgtctatggagatgcggtgctgcatctggaatccagcagtttggactataatggacggagcgtagaacttactaagaacgaattgaaaattctctattacctgttcaggaacggtggaaaaatctgttctcgtggagatatgattgagtatttgtgggacaatcagttatatgtggatgacaatgctttgagcgtcaatatcaaccgcatccgggaaaaacttgtgggcatcggcctgacggattttattaagacaaagcaccgacaggggtacacgatatgaacagcagacgatattggaaaaacaggctgccatttctgctgacgaaccttgtttgtatggctgcactcactgtatttctgctggtgtgcggaaattcggtttccgcagtattattgatcctgatcgtatgggcattggttttgctgacaggacttatcctcacttactggaaacgaaagcggcagatgaaaaaacttctggatatggcggagcagctctccgagagataccttatttccgaagtgatggagctgccggaacaggctgaggatcaggtttactatcagcttttgaaaatggctggaaaatccatgttggagcagatcggggaggtcgagcgggaacgcctggagtacaaggaatacattgaacaatggattcacgaaatcaaaacgcccattactgccatgaaacttctatgtgaaaaccatcggatggactggacaaaagaacttctgctggaactggaaaagaccaaccgctttaccgaacaggctctttattatgcccgcagtgagcatacagagaaagattattctgtccgggaaatggcactgtcccaagtggtgcatcaggcgattgcagataataaatatctgctgctccaaagtggtatgcgtctggaagtggaggaaatgcaggacacggtttattcagatgaaaagtgggtgcgctttattctgaaccaactgattgccaatgcggtcaagtatcgtacggaacagccggttctccgcatttctactcataaacggcaggatcaggttgttcttgtcgtggaggacaatggaatcgggattgctgcgtccgatctgccccgtatctttgaaaagggatttaccggtcagaatggtcgtatggtccagcagtccacaggcattggcctgtacctatgcaaacggctttgtgaaaagctgggcattggcattacggcggagtcgtcggaacatggcacagcaatttccctttcttttcatattaactgtttgattcatgaagtgcagagctgagaaccgttctgcacttcttacatttttgttagaactttgtaagaaaacttgatacaaacgaagccgctcttattttacaatagagatcagaggtgataacaatgaaagaaattttgaaactggatcatatccaaaaatattacggaaatggcgggaatgttacaaaagcaattcaggacatcagcttttccgttcaagagggagaatttgtaggaatcatgggagcatccggttccggcaagaccaccctgctcaactgtatttccaccattgatatggtcagtgcgggacatatctatctggatggaaccgatgtgacggaaatcaatgaaaaacagattgcccggtttcgccgggaaaatcttggatttgtgttccaggattttaacctgctggacacgctgaccatttcggaaaacatagccctggcgctgaccatcaacaaggttcccgcaggcgagattgatgggcgggtgcgggaaatggccggaaagctgaatatcacggatattctggataagtacccctatcaggtgtccggcggccagaagcagcggtgcgcctgtgccagagccattatcaaccagcctaagctgattttggcggatgaacccaccggtgcgttagacagtcactcgtcccagatgctgctttctacgattcagagtatcaacgaagatctcggagccacgatcctgatggtgacacacgacgctttctcggcaagctacgccaatcgcattctctttttgagggatggcgcgatcttcacggaaatccgtaagggtggtgattcccgcaggactttctttgaaaaaatcctggatgtcctcaccatgatgggagggggcatgaatgatgtacgctaaactggcacttcgcaatgtccgccgaacagccagagattacttgatttatgtggttacactggttttgtcggttggaatgttttatggattcttttctctggtaagtccctattacaatgcgacacttcccgtacccatccatttagatgtactgaagaaaatgatgcggatcgcggtaccattggtgggactttttgtagtatttttgatgtcctatgttaattcctatatgcttcggcgtaaacagaaggaatttgcgattgaaacgattattgggatggagcagaaaacagttgccttcttattctttttggaaacttctgttatgggagctgctgcgattttattaggtgtactgttgggaatgctgctttctcagattatcagtgtgattgttgttcaatctttcggtgagaattaccatttgcatttgtctctgtttccggacacttttcttggaactgttatcttttttggtgcgattgtacttttgctgggaattaagaacctgtttgctgtacgaaaactgaaaatcattcagatgttgcaaaatagccagaaaggtgtagaaaatattcctttaacgaggcaggttgggaagtgggtggtggtctgtaccgcagtttcaactgtgatccttgggatgatggctgctctaagctgtttggttttacattatccggcagctcttttcagggtattgtttctgactttcctggctgctggctttttggtatcagctgtgtttttctttcttgccggcagaaagaaaagagatggaagtggtccgctaatggcactcacaatttttggagctgctgaagggattgctcttttggttctttccccgctttttgattcgttggtacgccaaagaatagcgatacaggcgtatttgacgatgccaccagtctttgcactattgcttcttgtattttccttgattgctttttttagcaatcttacttggtggctatcaaaaatgattcgtaagccttctgccagatactatcggaatctgttctggcttgggcaaatcaagagtagaatgggaaccagttccaagacgatgggggtcatctcctgcgtcctgacagcagctctggtcctcttttcctatcttcccgttctggcgcttcggattcaatcgtaccagctcgctctttctgtatacgatgtgcaggtagggacgatgtaccgggcagaagaatctttgttaccaacagcgactctggactatgatgcgattaccgactatctggaacaagggggatactctgtaactggaaaggcgcagggagagctttacttccttgcgaatgaggatattggtaacgggcaaaagaaaattccgtttcttgcggtttcgttatctgactataatgaattgagggcgttgtctggtctggaaccggctgtgttgcccaatgatacatttggggtttcttggaaccgggaagcagtagaaacggagatgcaggaaattgaccgaaatatccgtcagatccaagtgaatggcattgttcttaataaggcccaggacgccgactttcaggattcgataggaattaacctgtttaccagcaggacaaaagcggtttatgttttgccggacgtagctatctcagaccttcggattgcgaccacattttattctgcaaataccgataagcctttaacttatgaatttgcaaaacaatttgaagaaaatatgggcacatatcagagagaacttgggaatttcccgccggagtctgcatttattcgtttgaataccttacagtccaatgagggtatttcaaatatgctgttattgtcactgattggcacttatgcggcgcttgtgttgttagtaagcagttttactatgttatcggtgcaacagcttacagatgctattgaacaaaaacatcgttttgacatcattcgtaaattaggagtggagcgtaaagaatgccagaaaactgctcgtcggcaaatgtatttctggtttggacttccggttctgatggcgatagttggaagtattggagttttttcctatttgctttggagcaactacaatgagattatcgcctatgttttgccttcgcaaattggaataatcctgaccctatcctatatctcttttataatcgtctttggatgttattttgtgtcaacctattacctgtttcaaaggaacatagaaaaacattaaaggaagggaggtcgtaatgatgtactggaagttagcaattcaaaatatccgcagaagcctgcgggattatatcatttactttgtgacgcttaccttgactgcggcattgatgtactcatttttggcattgggcttttcatcagatgttcttgctatggcagaaaatatgtcgatgctgacgactggaattttgcttatgtcagctctggttgcttttatgtcctcgtttgtgatcggttatgcgatccgctttatgctaggacgacggaaaaaggagtttgcaacctacgaattgattggcatggaagcaaagacagtacggaatttgttccttgctgaaaacagtatcatcggcactggggcctttctgcttggttctttggttggcacagggctttccggattgctgaatcaggtggtaaaaaatatctttgaggtgccgcatacctatcaggtttccttttctctccaggcatgggcagtaacatttttgttttttgccttgatgtatggttttgggatgtttcgggcggcaaagattatccggcatcagaaagtaatcgatctgctgtatgataaccgcaagaatgaagaataccgtttcaaatcattctgccatagtcttttggtagtattgctttcaatagccgcaatggttgcaggcgtgattttgcttgggcggatgcttcagacacaaaccaatgaagcatttttgtaccttggcggagcctgcttgctcattctggtgggtgtttacgagctgcatcgccagatacctcttttgctgcaccgatttgcaaaacaaaatttgcgccataagtacaaagaagaaaatctgttcttcctggggcagattgggcggcgcatccattctgctggccggacaatggctgtggtggcaatcctgttgaccatatccctggcaaccatgtttgtggggcttaccatgggggcaggctacaaagccaatatgaaagcctattatccctatgatgcaggcgtagcgattgatgcacctttggaaaaatccagcatggattccatcgtttcctttacagaggagcattgtggagtcgaggattctgtgagctattatctgtatgcggttcctgaaaaatctatcgaagccttgtccttgtccgactataaccacctgcgtgaaatcctggggctttctcctgttgtcatgggcaacaacgaatttttggttcattgtgatacatggaactatatggacggaatccggcagggcttgaagcagcagccggagatcacattaaatggtcgaaccttgactattgcagtgacaccaatcctgacggagccgatggagcagtatcaaatggccggaacgaagggatatgtacttgttctgccggatgaagcagcttcacaattagtcggagaaaaaatccgtctggcgatgaaactggaagatggcggatacccggaattgaaaagcgacttgaagcaattcctgaacagtgggaaatggcagccggaattgcagtcaggtcaacagctcccggaaaaagtaacgatgggtgttacagtaagggcgtggggcgttgccaattcgctgactggatttacagccatttcgttctgcggattgtatttaagcattatttttatcattctatcctgctcggttcttgcatttgagcagctgtctgccatagacaaaaaccagaagaattatgcagtcattgaccttttgggtgtaccgggccgcaggcaggcttccctgatccgcagggaactgtccacagtctttttgatcccactgctattcccccttttgctgacggttctgctgattgcaggggcacagttctttttcggagaggcaattttgcagcagggacttgtacctctttatggtctggtgacgattctgctattctgtgcaatctacctgacctattttggtgcaacaatgttcttattcaaacgggttattcttcggcctgaaatgagataaaaattgaattgctacaaaaatgaagcaattccgcctgttttcttgccgaaaaagaaagcggttaggagatttctgcaacatttggcctttatcatagagtaataaattagaaatgctgataccttacactatgcaaaggagtggattactatggcaaacaaagaaaagcgctttgaaacaatctatacacagggaacttccttgagtattgttgtagacaccgaaacaggtgtaaactaccttgtccatgatacggggattacccctttgctggataaaaacggaacagtcgttattactgaaataaacaagtaaactttatattggttgcagggtatcagcattctaattacgaataagggagggacatatgggaaaaatctttgtattgtcggtaacagaccatgaagaatacatacttagcagaattatggagattattgcagccgagccaggatttgaccatattgtgtcatctcacccttgtaatactcttgtttttccgggattggagcttcgcctgaaggagagaacggtacaccgaaacggcgagttaatttctatgacccatcgggaatttgcgacattggtatacttggcaaaccacccgtcctgggtattttctgctgggcagatttatgaagaagtgtggggtgaggatggtgaaaactgcggaacagccgttgccagcgtcattggtcagatccgcagaaaactgactccggatatgccgaaagcgggttatatccgtactgttttggggagcggatacaaatttgaagttccgcaaggtatggcagaatagaacaatcaaatatatattagctgcgcacattatgaagcagccaaaagcgggaaacctttatgatgggtctcctgctttttgttttcataaaaatagtgtgtgattgttgagaataggcgtcatataggcgtaaaggatatgtataaagtaaaaaggaggcattacatatgcttattggcgttgatcatggcaacaaacaaattaaaacggttcattgcaacccctttgtgtccggtctgaagcagagtgtcacccgtccctttggacagaatgtgctgaggtatcagaatacctactatacgctgtctactgagcggattccttatcggaaagataaaacggaggatgatcgcttctttatcctgaccctatttgctctggctggtgagattgaagcgaggggagcatattcctcagaggttcagcgtatccaactggcggtagggttgccgccggcacactttggcgcccaggtggagcggtttacacaatactttgggcagcggggaatggtagaatttgaggtgcagggaaagccgtacaccatctatattgaagatgttgcctgttttccccaggcttacgcagcagcggccaccatgctccatacgcttgtggaggagcccaaagcggtaatcctggatattggtgggttcactgcagactatttgctgatgaaaaacggagagattgaccttacctcctgcgattcgttagaaaatggtgtgatcctgctgtacaataaggtgcgttccaaggtgaattcggaactggacctgttgttggatgaaggggatgtggatgccatcttgatggggaaaaagaccaaatatccggaagcagccatacggctgacagaacagatgacgcaggaatttatcagtgacctattcagcacgctgcgggagcgtatgatagacttgcaatactgcaaggtagtctttgtaggcggaggtgctattctattaaaacggcagatcgaaactgcaggaaaggtgggagcaccattcttcgtaccgaaaatcaatgcgaatgcagatggctatgagtatctgtaccggattgaaaccgcaggcaggtgatggcatgggcgagaaaaaagaacgaggacggtttacgctgcgattcaatgagggcgatcccatacacgaagctgccattggattactggaattgcagagtccccgcacaaaagcgcagtatgtggcaaatgcagtggtctactataatgagcactttgggcaggaaccgcagccgctaaatgcttcggttattagcaaagaagcggtggtagctattgtcaaagagattttgtggcaggaaggtatgggacaggaaaaagcaaaagagcagatttccacagccagattggtggagaagcctgcagcgcctatgatgctttcgactgcacaggaagtaggcgatgatccggaaatggacgatagaatgcgcagtctgattgctggcactttgtctgcattccgtagcagaggataatcaaaagaggcatgggagccagtgatgctcctatgcctcttcccgtatggccgcgataaagctgtctaaaatatcttcaaaatgcctgtattgtttgggcgttagtgtggaaatcttctccataagaagggaggaatctgtttctgtgatgatgcctcgcaacaagtattcggtgctgatgttgagtgcatcacagactttgaggattgtttcaggtcgcatagccttttgtcccagttctgcggtggagatggtctgtggtgtgacatgagccagctctgccagagtttcctgggtcatattcagttgtttcctccggtcgaagatccgtttacccatatcttttagtagattatccatgcgtcacctccatgccatagttacattttatccgctatgacatggattattaagcggtcatggttgatttatctcgtctatggcaagtataatagacgaagatggatgccgggaaaggagaaccatatgaacagtttttcgtgtgtgattacaggccataggccgactcgtttcaagttcaaatataacgaaaaggacaagcgctgccagcggatcaaaaagtgtctgcaggagcagcttatacggctttataatcagggagtacgatgcttttgggctgggggagcaatgggagctgatatgtgggcgtcagagatcctgttgcgcatgaaagaacagacggcgtatcaagatgtggaattgtgtctggctctcccctttgagggatatgatgcagattgggatgactggcacagaaagagaatgaagtttattcgtaaatatgcagcgaaggttttaatcctgggtgaaatgccatcaagtgagaattataaaaaacgcaattgctttatggtggatcaggccggctgtatggtggctgtttatgataatgtaaacaatatgcgatccggaactcagcagactgttaactatgccaaaaagaaaggactccaaatcatttatatccatccggatacggcacaggtaacgacagaagatgcaactttatggaaataataaaggaatagctccaaagcggaaaaatgcagtgaccgttttggagcttgttttgtcatataatgtcgaatgattttctctttcctcgaaggatattccaatgctactccaaaagtttccgaaaactgtcagttacactgtaattatggcagtgatcccaaaaatcaatgaaaattcagcaagcggaggtgggggtatgagatcagtacgatacccaatgaaaatcggaagtacagggcggtctttatcctgatgatggggataaaggccgcctcctgttttcatatagaatagctctggaacagtatttgaaaaaagtattattttacaatttaacaattatcagcagggcggcagcgttgcgctgccatatcgcgaaagaaaggggatgatgcaggccgcctgtgtgccgtccgcataactgcggacagggagtaacggtgttatggagaaaggattccacgacatcgagcagttcattgctttcataactccaggacacacggcttttcatgaacggctctcaataggggtatatcgtcgaggtagggcaagagagttttcttcatataaagataaacctccacctgcccgaacggtatctattgaactgctcgatgcagaaattcaagaaacagctggttttgtccattggtacaaagctggctgtttttctttatatcaggcagttttggcccgatgcaggtcaccgccagaagctcaggaaatccatcggaattcttgagacttttggaggtaaagccatgtggcaacggaacaatgggcaggcagaagatgacctgcaatttagatttacagcatatttggtgtcggcggtcaagcgccgcagaaaagattatttgatccagctttataaacgaagcagtatagagagtgctgtggaagtggtctatgagtctgaacccagctcagaggaagtggtcttggacagattaccgcttatggatgtcattgagaatggagcgcttctggaggcgttgcagaaactcaatgaacgggaacgccagatatttctggcccgaacgctggaggaagaagattttgagactttgggagcaaagtttggactgtcctataaaggggcagcggcgctttactacaggacgattcagaaaatcagaaagagtattgtagtaggaggtgacaagggatgaattttgaatgtctgcttctcaatgccaaagccggaaacgaggatgccattacagtgattttacagatgtatcgaccattgctactcaagtatgccattattgatggtgtactggatgaggatttgtaccaggaattgagcattattttgttgaaggcgattaaattatttaagatttaagtcaatgagaaaggctccgagatcattatggcctcggagcctttcttactgacttaaaagggagaactgttaaatttatatccgctgcccagtacagtctggatataaccgcccttcggtgtgtctggcgtcagtttgcgacgaatctggccaattacactggcaactgcagttccgcagtgtccaccatccgaattccacacagcctcgtagatctggctggcagaaaatacccagccaggatgacgagccagatatgtaaggactgcaaattcatggtgggtcataggaataagcttgccactacagtacacagtatgttctttcagtaggatttccaaattggaaaaggaaagacttgactgtggaggggcaatatggtcaaaatctggttcatctgcgatggctgccatgactctattaaaaatatgttcttcgtggtcagaaatggacactatcaagagttttcccatattgtgtatatccccctcctatatacttatatttagtgttcgatgatttttccttttgtcagcgaatacgggctttcgttatagtaaaattaggttattgctttttttcagaaatagtatggctttcggttatggatatttccctatgaagatgtattgccataaacagtgtgattactacggaaattatatctgcaatgggctgggcatatagaattccattcatgccccataccataggaagcagcaaaatgacaggaacaaagcagataccttgcctgcatgcccctaaaaagaaacctgccgctcccttgcccagagcaagaaatagagaggagtataccgtgtagaaaccgaaaaaaacgaatgtaaggccgttcgcaaacagggatttttgaccggctaaaaccatttgaacatctccctcggtaaattgagagataatctgcgtggagaaaacggccatcaccaaacccacgactaagcagaaacttgtagaccaaataattgaggttttgattgcttcgcgcagacgatcaaatttctttgccccatagctgaatccggcaataggctgaaaccctttcagaaatccaaagacaacaagcgttcccatagaagtaattcgagtgactgcccccatgcctgcaataaccgaatcgccataatcgctggctgcacggttaatcagagcaatagaaagacttgtaagcaactggaataccaaagtaggtacaccgattttcaagatttccaccatcatttgcccatttggagaaaatgcttttaagctgaaagaaaatgcacttctttttcgcagaatgtatgtaagataaacaagtgtagatactagctgagaaattgcagtggcgatcgctgcaccggcaacccctatgttgaaagtgtaaataaaaagagggtctaatccaatattcaacacggctcccaacagtaacgcacacatagttgtttttgctgcaccttcactgcttacaatattgttcatggtcacattaaacacattgaaaacacaggacaatatataaattcttgaatatgtcagagcatacggcatgatagtttctgtcgcgcctaacatagtcaaaattggtttaaggaagattgtagagaaaaggatgataatagcgccaatcagaagactgctatatagagcggtacttgccaccttattggcagtatccttatcgcctcgtcccagaagtcttgataggtaggatgcagcaccgttgccaaacattagtcccaatccaactacgacttgtcctaatgggaaaacgatggaaatagctcccatttgactttttcccagtccgctcacaaaataggcatccaccagattatatagggcattgattaacattccaatcataatcggcacgccaagcgccatcagagctttggggataggcgcactgcccaaaagctcaagtttgttgttacgttcactcattgttaatactcctttcactctttgaaggtataaaatagagtagtataaattatagtatactaccgaatgaatatactactataatttatagtagatgtcaagaggagagaggcgatttgccttgacaaagagtataaagtctactactataatttatagcgactttgacggtaatatttcatgcagagaacatagcgaaagggtgtgatccacatggctaccatagatttaatcgtgttgggaattttaaaaaaggagccaatgagtgcctacgatattcaaaaattagtagaatatagaaaaatatcaaaatgggtaaaaataagtaccccgtctatttataaaaaagcaattcagttggaagaaaaaggactaatccgaggcgaaatcgtaaaggaaggaaagatgccagaaaaagcaatttactctctaacggaagccggagaagcagaatttgaacgcctcatgtttgagatttctgcaaagccgattaacatttttcttgacttcaacgctgttattgtaaatttggatttcttgcagatcgaaaaacaaaagtcgtgtatagcagaaattcaggaaaatgttagtgtcttaaaatcctatttggaagataatatacgggaaaaagaaaacacccccagtattccggaaacaggtatggccgtcttgcgtcagcagtatgtactggtggaagcaatccaagaatggattagttctttaaatattatctgaaaccagcattcttataggaattatagttgattgagttatagtgttcatgtctcatggaaataagaaaggcttcgagattattacggtctcgaagcctttcttgctgccttaaaagggggaactgttaaacttatatccgctgcccagtacagtgcggatataaccgcccttcggtgtgtccggcgtcagcttgcgacggatttggccgattacactggcaactgcagtgccgcagtgctcaccatctttgtgccatatagcttcatagatttgatgagcggaaaatacccaacctggatgacgagccagatatgtaaggactgcaaattcatggtaagtcaaagtgatgagggtactgttgcaatatacagtttgttcctttagccgaatttcaagaccagggaaggaaagtgcagactgcggtggagatggtgcaaggtggataaactccggctcatccgcaataagctccataattttattgattatatgttcttcacagtcagtaatggacagaatcacgagtttccccatcttgctcacatcctttctcacttgttttgtgatattttattctgaagtcctcagccgctccaccacagttcctttgttaaagaagtggagaacgatcagcggaataaccgcagccagcagcagatagagcacaccaatgaccagaacaggaaccaatgtaatgttcagagtaaagaaccacatggaagggccattcaatgcgctctttagcactgtgactgccaggatcgctgcgactgctccgccgataatgtccgcacctacggcatagtagatgccctcatagaccgtcaggcagcgaagctgcttgccggtcataccgatgctctgcatggtagcaaactcatggcggcgggtgatgatgttggtaataatcatgttggtaaagttaatcagtcctgcaaaggccatgatgcaaccaatcagaccgccgataaccaggatcatgctgcggaccgaatcaagctgctctttcaacagcttggtggaagtataggcaaccgaagtattttcactcacatagctgctcaaaaattcttccatctgcggctgcaaggcttcatccacattgaatccataagtcagcagcgtgggagcgtcatagatttccttaaatacagtgtccggcagatacacaaaaggagcatcagcggcgatgtgcgcctgggcggtggtgcctgtcggcgtttcggtttccgttcccacgaggatcgcttttgcaaggatagtgctggttttgaccagttccccatccttgtagaaggaaatgctctctccaacctgtaactgatcggtcagcggagtgttccttggttcctctgtcagtttgtccatgggacagccaataatgacatattctccggtagccattttctgagttaaggtttcggcatctttttcgccttcaaaaatacacatatccgcccagaaattctcggaggctcccatcacattaccaaaatagcgcctttcggtatcagaacttgtgtacaggctatatccctgatagctttgatttacgacgccttcttcctcatggaatagctctatgccacttaaatcttcaaacccatagtcaaccaacacatttctatcgtcttttgtatttcggtaaagatagcgttcatcctcaactccgggctgtccggcaatcagatccaccgcctgctgtgagagcgtatcttcatggtgctgaacgctttccattacattaaatgcggcggagttatagacattaaaatctgttctggtaacacggtttacccacttttcttcatcaaggctttgcgtcacaatgatgatagagttaaacaggacgatgcacagaagcagggaaataatgatgaacgctgaacgcctgcggttgcgccccaggttggaaaaggccatgcgggacagctttactccattggtacgcttggcacttctctttttataggcgttctgctcggtgtagcggatcgcctccagaggagaaatctttgccgccttttttgcaggcttccgggtgctgataaacacggtcaggatcgtaaagagggcggcaataacaaagatcagaggcgaggtcgatacggatgtacccaccatagagtattcaaggttaatgatctctgtcacgataggaagcagcacccagccggcaaagaaaccggcaatcagaccaataggcagcccaatcagcgtgagccagactgcctgacggttcacaatacccttgatctgccgtgtggaagttccaatcgtccgcagcagaccgtattgccgaacatcctgcattacggaaatatcaaaaatattgtagatcagcaggtatccgcacacgacaaacatcaggataaatacaacagcaaacacgatggactctgatgaagtcaatccctgggacatttgattttcagaggcgagaatgaaattgtctgcgcccatatcctctggattgccgccaatggagcaaacgaactcattcaactgctgctgaacatttgctttattcttcagcacgacatcggaaaaagtaacgccggacatttcatggtctaccgcataagtgttctggaccacatcggggttttcctttataaactgctctgaaacagtcgcaacgctcacagagtcattgcttgcttcccaccagccggaaagcaccatatcgtaatgataagttttcccccgcagttcaaattctaacggaacctctgcgccgatctcaggttctacacccagcgccttcagcgccaaatccgtagtggcgatctcattcgctttctccggtgctgctccatgggtaggcacgcagaaggtcagctcctgctgcacactgtccgcataattgatctcaatggaatggctggaagtattgcttgcatagccaatgatgcgccggtgacctgcctgctccacaaaatcgctgtttacaagctgttcatactgttcctccgtcatatatcctaaagtgccatccgccttgctgcctttctgcatttgcagagagagctggatggaggacgccatattgaacgccaaggaagtgatagaggtaaacaggaaagcagtcagaatgattgccaacagtgcagccagattgcggaccttattcttcttgaaatagcgtttggataacttggttatcactttggaattattgttgccaaataaaatatcattcatgttggtcacctcctatgcctttactcatttacccgaagccgttctacgacacttcgattgttaaagagccggagtgcgacaacgggaacgataaacgccaatgccaaaaacagaatcagcataatcagcgccgggagcaaggtcatctggaatgtcatcataatactgcttgggctgatctctacaaaagatcttaccaatgttatgccaagcacagcagcagccagcgtaccaacaatcccggccagcagcacataggagaaactttcagaaatcatcatctttcggagctgccggttcgtcataccgatgctctgcatggtggcaaactcatgacgtcgggtaatgatattggtcataaccaggttgatgaagttgattagaccaaccagggcaaataccgcgccaatcattccgccaatcagcaggacaacattttttacaccggaaacagttgctttcatcgtcaagatagaagtataggcaacatctgtatcctgcgccagataggtttccatctcctgctggtactgttcctctacatcaaataaaaaaccgtacaaggtaggagtttcataaatctccttgaatttgttttcagccataaaaattcttggaccttctattatttgtgcgatatttgaaccgccgccagtcacagtcacatctccatcagtagctgcggcttttgcgataatggtaaactccttggttggagttccattttcataaaattgaatggtatctccaactgataatccaaaataaaaagcggactctgccccagtaaagttaccatgatcgtcatattcgcccattaaaattacattgttgccattccaaagtttgttttttaagacagataaatcagtttcaccttcgataatgtccagccgatcaaagaagttttccgaaaagccaaatacatttccgagggggtggttatccgcagtcaacccaacagtatgcccaccattttctgttcggtaaacacctaaattgaggtgttccggcagcattcgctgctccttatttgtgttatcaaccacatagggagttccccagtcacaagagatatggtcatcttcaaaagtgttccggtacagataggcttcgtttgtgactccgggctgttccttgatttcctccactgccttctctggaacagcactgtcatgcccaaagttatctccccatgcagcttgaatgactggactatatactctaaaatcacttcgggtctggttttcgatatagacatcttcgtcaaagctgctgctgaagataaacaccgagttcaagaagacaatgctcaaagtcagggaaatcacaataaagactgtccggcgcttattgcgctgaagatttgccttcgccaggcggggaataactgacccggaagctgtcttttttcgctttatggaaacagcgtcctgatctacatatcggatagcctcgataggggacacacgggaagctttctttactgcctttctggtactgatataaaccgtaagtcccgagaacagaattgcacccacgataatccccaaatatgggagtgtgccgacctcaatgtttccaccgctgtaatcaaccgcaaatatctggagtgcagcgggcagaatactgcggccaagcaatgtgccaaaaagcagaccgaatggcgtgccgatcagaaacaggtacagtgcctgccgattgaccaaacgcctgatttgcctagaagttgttcccacagtcctcagcaagccgtactgtcgaatatcattggttacagcaatctcaaacacattgtaaatcagcagatacccacagaacatgaacaggacgccaaatacacccgctaccagccacatcataaggccgctttcattggaaacaataggattaggagcaacacggactgcgttgtcagcactggcatcatccggattaccgccgatattgcggacaagctctgaaatgcggtcctttaccatgtaattatcccgcattactacatcggctgtataaataccacagccaacacgcccctgggcaatatcgctcatcatttctgcgttttcttccagaaaggctttggaaacaatgaccgattccgatttttcatttggtgtgtcgtaaataccggatacgaccatatcaaaatgataaacctgatcactttgacgaaccttcaattcaacaggaatttccgccccgattttttcttcgatgttcagatccttcagtatattggcagaaaccaaaacctcatttgctttttggggtgcagagcctgtgcgcggcgtcagcatccgaatttccaactggttctgatcggcataatcgacctctgcaacacgccggtttgtgttggtcataatttcgactggtatccagcagcccaccttttcaaacatggcattttcttttaactgctgaaactgcttctcggaaagtccctgcaccagagcgtcagcagatgaccccatcagttttgccatgctgtattccagcgttccactggcacccatgccaatggtcaggactgccgtaaagagaaaggtcgtcagggctatcgcgatagctacaattacattccgcattttgttactgtgaaaactgcggtttgccagctttttgatgacagccttgttgttattgccaaatagaatgtcattcatagtcccgccccctttaccgcacgatcttaccatcctcgatccgaatgatacggtcagcaagctgggcaatctcactgttatgggtaatcatcacgagggtctggtggaattttgtgctggtaactttcagaaggctcagcacatcgctgctggtcatactgtccagattgcctgttggctcgtccgccagaacgatagcaggcttcgataccagagcgcgggcgatggctacacgctgctgctgaccgccggagagattgctgggcatattgttcagtttatcctccagccccagcatccgcaccacttctttcataaacttcttgtctaccttgtttccgtccaactccacaggcagcacaatgttttcaaagacattcagcaccggcaccagattgtagttctggaagatgaagccgatctttcttctgcggaagatggtaagctgctcatctttcaatgtagagaggtcgcgcccatccacaatgaccttgccggaagtaggcacatccagcccgccgatcatgttcagtagcgtggatttgccgctgccggaggttccaacaatcgctacaaattccccctgctcaacagagaggttcacaccatccagggcctttgtgatattcggctttgtgccgtagtattttttcagttcagtcgtttgcaaaatgctcatagagaacaccatcctttctttaacttagacccattgtaacgaacaaacctcacagaaatgtcacgagccacaaaaaatttccgctaaattcggccccaaatgtcacaagttcgtgacatttgaaaaaccgggagaaaaatcccccggttttccgcgtcccacagccacatacgacggcgcaggaagtattcacttgatatggctgcgcctgttattcatttacccgaagccgctctacgacactccgattgttaaggagtcggagtgcaacaaccggaacgataaacgccagtaccagaaagagaaccagcataatcagcgcaggcagcaaggttatctggaatgtcatcatcatactggtaggaccgttttctacaaatgctcttagcaatgtcatgccaagtgtcaccgcaactaatgtgccgacaatccctgccagaagcacataggagaaactttccgaaatcatcatttttcggagctgccggttcgtcataccaatgctctgcatagtggcaaactcatgacggcgggtaacgatattggtcataaccagattgatgaagttgatcaggcccaccaaagcaaatacagcacctatcattccgccaaccagcaggacaacatttttaatgcctaaaacatcagctttcagcgttgtaatagaattataggaaacatcggtgtcccgcatcagatagttctccatatcctgctgatactgttcctctacatcaaagaggaaaccgtacaaggtaggggtttcataaatctctttgaacttattttctgacatatagatctttggtccaccaacatctgtcgtaatattatcgccaccgccagtcaaagtcatttcattgctcgtaacagcagcctttgcaatcactgtaaactcctcagtcggagctccattttcataaaattgaatggtgtctccaaccgacaggccaaaataatagatattatccgcaccaccgcttaagtttcccttatcgtcatagtgacttactaaaattacattgttaccattccagagtttttctttcaggacagacacatcgctttcaccctcaatgatgtccatcttgttcaggagattttcagagaagccatacacattcccaagaggaaggttatccgcagtcaacgcagcataatcctctccatcctcagtccagccgagatttaatgaatcaggaagtacataggcatatttatttgtattgtcaatcgagaaagaaggaccccaatcacaggcaatatgatcatcctcaaaagtattacggtataggcggacttcgttcattacacctggctgctgttcaatttcctctaccgatttttctgaaacagtacagctatgcccaaattcatctccccatgcggcttgaatgtctgggttataaaccgcaaagtcacttcgggtctgtttttgtacataagtagcttcatcaaagctgccgctgaagataaataccgagttcaggaggacgatgctcaaagtcagggaaatcacaataaagaccgtccggcgcttattgcgctggaggttggccttcgccatgcgaggaataactgctccagtatttgtctttttccgttttatggaaaccgtatcctgttctacatagcggatagcctcgataggtgacacacgggaggctttcttcaccgactttctggtactaatataaactgtaagtcctgagaacaggatcgcacctacgatgatacccaaatatggaagtgtgctgacctcaatgtttttaccactataatcggcagcaaacatctggagtgccgcaggcagaatactgcgtccgagcaggatgccaaaaagcaggccaaatggtgttccaatcaggaacaggtacagcgcctgccggttgaccaaacgcttgatctgctgggaagtagtccccaccgtccgtagcaggccatactgccgaatatcgttggtaactgcaatctcgaatacattgtagatcagcagatacccacagaacatgaataggacgccaaatacacctgctaccagccacatgatagagccgccgctgttgttggaaaggaaagtgttgggggctacacggacataattctcagcacttctatcgtctggattaccgccaatgctgcggacaaactccgagatacgctcctttaccatggagctatcccgcataatcacatcagcatcataaatgccacagccctcacgcccttgggcaatttcgcgcatcatctccggattttcttccatgaaggctttggaaacaatgactgattccgatttttcgtttggtgtgtcgtaaataccggatacaatcatatcaaaatgatacatctgtccgctttgacgattcttaaattcgataggaatttctgccccaattttttcttcgatgttcagatccttcagtatattggcagaaaccaaaacctcatttgctttttggggcgcagaacctgtgcgcggtgtctgcatccgaagctccaactgaggctgatctgcgtaatcaatttccgcaaccatccggttggtgttggtcatgatctcaatgggaacccaacaacctaccttttcaaacatggagttttcttttaactgctggaattgttcttcggaaaggccctgtaccagcgcatccgcaccagtgccgatcatctttgccatattgtattccagcgttcccttggctcccataccaatggtcaggactgctgtaaagagaaaggttgtcagggcaatcgcaatgaccgcaatcacattccgcattttgttgctgcggaagctgcggttcgccagctttttgatgacagccttgttgttattgccaaatagaatgtcattcataggcctgccccctttactgcacgatcttaccatcctcgatccgaatgatgcggtcggcaagctgggcgatctcactgttatgggtaatcatcacgagggtctgatggaatttctggcttgtggttttcagaagccccagcacatcggcgctggtcttgctgtccagattgccagtcggttcatcagccaggacgattgcaggctttgacaccaaagcgcgggcaatggctacgcgctgctgctggccgccggaaaggttattgggcatattgttcagcttatcctccagccccagcatctgaacgacttctttcataaacttcttgtctaccttgtttccgtccagctccacaggcagcacgatgttttcgtagacattcagcaccggcaccagattgtagttctggaagataaagccgatctttcttctgcggaaaacggtcagttcctcgtctttgagtttggacagctccttgccatccacgaccacctggccggaggtgggcacatccaatccgcctatcatgttcagcagcgtggatttaccgctgccggaggttcccacgatggctacaaattcgcccttttctatggagagggtcacaccatccaaggctctggtaatgttcggctctgtgccataatattttttcagttcagtcgcttgcaaaatgctcataaagaacaccatcctttctttttgataaactcattgtaacgaccaaacctcacagaaatgtcacgagccacaaaaaatttccgctaaattcggccccaaatgtcacaagcctgtgacatttcaatttttggggcgtgtcggcactactttcggagcaggaaaacagaaaaggttgagcctttcccgacctcggacgccaccctgatataaccgccctgcaaggtcacgatctcgcgggccagatacaggccaatcccaataccgtccacatcatgcaccgcatcttcccggtaaaaccgtttgaaaatcgtcccctggtgctgttctgagatgccaatgccggtatcagcaatgtcaatcttcacatacatttcccagccttccaccgacacacggatctgcccgcctgccggggtgtatttcacagcattatccagaatgttgaacagggcttcgcttgtccattttctatcatggcgcgcatccaaatgctccgggcattccacctgcacatctatttgtttcttttcggcattgagcaaaatcccgcccagggcagcggcaagggtatcataaaccggctgctgtttttgctccagcgaaatgactcccgtttccaggcgggaggttttaatcatggcttgcatgaggaagtccagcttatcaagttggctggcctgggctgtcagaaattccttttgcttctgcgggggaacctcgttttcaagcagcgtgttgttgatcatcttcaagttggcaatcggggtcttgacctgatgggagatgtcggagatcagctcttgcaggtcagcccgttcctttgcgatgctgtttttattttcctgcatgacctcgtacagccgccccagccggtagttgattttatagaacaggctttcttcctcgaccgtctgcttcggctgcatatccccggagagcatatcatccatctgaccacaaaaggcatcggagaaccggaccagcttccggcggatcagggccacaaagaagataacgcagagcagtacaaagagactgaacaggaacacacaccggacagcggttatattctgggtcagcagataaacagcggtgcagactgcaccaactgccagcagcagaagcgttcccaaaaggatgcaggctttgttgatggagagttttcgcatattcatttcggtgcccctccaatccacatatagcccataccgtacaccgtcttgatgtactggcggccctccgtttcaattttgttccgtacccggctgatggccgcagtcagggcgtgttcatccacaaagttcccatcggcatcccacagcttttcaagcagcacctgtctggtcaaaacattctgcgggtttttggtcatgattttcaacagccggtattccaatggagtgaacaccagcggcttaccggacagggaagcagtcatctccgagaaattgatggatagtgcgccatcctcatagcaatcgcctccagactgtttcgccacccgccccaataccacggacagctttttttgaaagacactcatgggaaatggcttggtcacatagtcttctgcgcccagctcatatcctttgagcatatcgctctccatatcatttgcggtcaggaagatcaccgctgtatccggccggcgctcctttacctcccggcagaaatcaaagccattcccatccggcaggtttacatccagcacgatcaggtcatagtcctgcttggtcagaaagttgctggctgctgattttgtcaatgcagagtccacggcatagcccgcagcatccaggttatagcacaaggtattattcaaaagtcggtcatcctcgactactaaaattcgcattatatcacactccttcattcttagtgtagcatccaaatgtcacagaaacctcacgagaggattatttttttgtatttttgaaacgatggtctgccggtttctccgcatccttgggaatcagccaaatagtagccatcttcacagcaccggggatacgcccaccggcatacaaataattgatctgacttggggtaacaccccattttctgctgctttttcatggaatataagttatgtggattcatatgattactcaattataatttcttggctcaatcaacgcaaggaagtaatacttgtagccttgttttatataaaacgaagcgccggacagagccaatcggcatatgtccggcgtttcctatatcacggattcaaatttatatccactgcccagtacagttcggatatagccaccctttggtgtatccggcgtcaacttgcgccggatctgactgatgacattggcaacggcggtgccgcagcgttcaccgtctctatcccatacagcctcgtaaatctggctggctgagaatacccagccagggtgacgagccagatatacaagaactgcaaattcatggtgagtcagagtaacaagttgacctctgcaggatactgtctgctcctttagtcgaatttcaagatcggggaaggagagacaggcagcagagagcgggagagcaatacggtcaagctctggttcgtctatgattgctgccatgaccctattaaaaatatgttcttcgcagtcggaaagtgatagaaccagaagttttcccatattgctcacctcctcgtaaaatgtaaagtgctaatccccaaaatcatagatagaactctgggatattactttttttcctaaaatagtaattgctttcttgctgcactgatttacgcaccgataacataaggtacaccgtccatttgctacaatcttacctttggataatgacaaattattcataggacataccaatgcacatttgccgcactttatacaagtgtcggaatttatctgtattttgtctgaatacgcttgtgttttacggtaaaaccaaagccgctgtcctaacagacctgcaatatgacaccaaaagcctaaaccatttttagttggagtgccatttttcaaattgtacactgctgattttatacattcttctgcttgtatgacaatttgcttattttgatctggagtacgctttaaggcttttacatcacaaatgcaatctggcattttcaaatgaagtccaccccatatgtgtgctccgtatcgcttaaacaatcttgcagatacacccgcaccatcgccgctaaacagtcccattgttgcaataataaaaatgtgttttcccttccatacatcagaatttccacagataaaatcctgtactattttaggcaggttgctgtaatagattggataggcaaaaatgatgtctttatgatgtgcaactttttctattgtaccttcatcctctaaaggagttatttcaatgttcctatcatatagagcaacaaacttttctaaacaatattttgtatttcccgtcccactaaaataaatcccaatcatattttttctcctgtattatctataaaaggaagctgaaaaacatccataaaatcaatgactttctccctccagtcattatcataatttacattattcatggtggctaatgaggtaacaccatgtataaaagcccaaatggttatgataatatcattttgcttttcttctggatagtgcgactgctctagtagtttacttacaatatttttatagatgatatagggtttatagttttgatcgtctggtatcgataacgataagtcaatttttatgttggattgcgaatataaaaattgaaaataagcagggttatctacaaagaaagacacataggctatccccatatctttcaatatttctacaacattattattcttttgaacggtactttctaattgtttagaaaatctatctgtgataaatagttgcattgcttcaagcaattcttctttattttgaaaatggctataaggggcagcgtggctgacaccacacgccgcagctaccttcctcagagaaaaagcatttactccctctgtacttacaagctgaatacctgtttcaatcaaagcatttcgcaagtctttgtgatgataagtttgtcgttgctgtgccatgctaaatcctccaatctttacactgtctatattgtacttcgttatctttacgctgtcaagtttgtagtggcttttatatcatagaggtcaaaatgagtttacaaaggtaatatttttatgcgtatatacttgggagtacatagaaaaacgcaccagatacagagccatactgtatccggtgcgttgcaaactttttaacctttcagatagtaatgcacataggcattataatctcgatgccgagtaatcagtcgcagccagatataaaagtgggcggtttccgaatacaaattgaattcggagggctcgctggtgggctgggcgtaccctcggcagaaccgtgtcaaggtgtccaaattccgaaactccggcagttggaacagcgcattctggaaagcatcaatttcacgggcaacttccagaacaggcgtatccttttggcactgatgccaggtggtccaccatttccatccatcataatcagaacgggaataggctatctcgctggcaggacgggagccttgctgaaacagatcttcaaaggtgcaggaagtagtcagcagcggatcttcaaaatcggtctgctgctggctcaaaccgtttttgacagctgcccattctgttagagggagtgggcaacggttggcatcacgcagggcttcatctataccgcacgcctcgcagatatggacatctgcatagcggctcagggcgttgatgaccagcctgcggtccagcggctgaccacatcggagacacaggggtggttgctccgcctctggggtaaacagcagtttgtcctgctgccatacagtttccaatagggatttgggatagatacggatcttcatgatgatgtcctcctattttattgtctttaatattcgtactgtttcctccggtcttcagaccagggagggtagacacgaagttcctcttgaaacatggccatcagctcggttgccatgtcctctttacgccgatagatgtgctgcttctccgtaccatcggcatagcggatggtagtctggagtgcgggtcctttctgtgtgaagatgaatttgcggccatgagaagggtcagacgcctcgatccagaggggcagggtggtggaaaccccatctggacgccgccagccgctgtaatcagtgtagctgaacccattgatttctcgtgccagccggcgcagggcaagatatagccgctcaaagcggcgccccagctcgcctttctgatgccggatgtagagggtgtgcccctcatggtccagggcgtccagttctttgccataaaacaggtattcagggtaaagacagccattcgattcaagaatttgcccggtaggttccgcaaggtgattgtctgacagccagactggaaaaagtccgtctgcggattttatattgatgaaagcgcagtggtcggggcggattccggttaagttggtggtaagggtttcccaaaaaatcaggatgctgtgatccttttcataaagtttgatggcgagattgccgttgggatatgtactgattttcaaagtcagctgggctcggtgttcgcccagcgtaaatgcgagagtattcataagcgttttcctccaaagaagcaccggacgcctgcaaaaatacagattgccggtgcttcttagtgtgtgttccggacaaggaaaccggagcagggagaggaatgcagttcctctctggtcatcgtcagctacacagccaaagtctttgactcgaactgatagcgcagaacctgagccagctttgtcctgttttcacaagtaatgcgataggtagggccatagttacgcccctgttcatccatccttcgaatggaaatgctaaaacgggtgccctcctgggtaatccacagacgcctgcccgtggcagcatcttcagcaataatccataaagggcactgcatggtcatgtaggtctgggggtaagcacgccagccgctacggtcatggtaacagaaaccgggggtagtctgccgcctttcattcagtacatcataaactgccttatatttcatgcgctgcaccgcctttcaaagtttttcaggtagcctgcatacccttccgggtccagctcctgcagccggttggcacgaaaacgatattcaggataggtgcagaacccactctgcatggtgcgaccggttgggatagccagaccatgtcgtatgagccaggtgggaaattccgaatcggcattggtgtcgataaaggcatggtctttttgccgttggccgggcaggttgacggtgagagtcgcccagggttccgggtcaccgctttcccatgtcaccatttgtatggcaaggtttccattcaggtaggaagtcacctgcagctggatggggtgcgtggcaccaaatttcttgtaaggcaaggtaacaggtgcagcatcggtatcagactctccgtcctctacgcccagttcccaactaagggacaaaatctggctctggctcagcgtgcgggtatatttctttgcgtattttggtttgaagagcagggcaccgtcctgcaggagcagttttccttctttttggtcctgaatacagcgcaggccatgcagacggggctttgcgcgctccaccgcatcgtggatctttggatggtcaaaccatatggaatactgtacggctacatggagatggggatgctcctgaaagagtgagcataggagctccagcacctgttgacagacttttcttcgtttctccagcgtctgacgctcgttaaaggtcagcgtgaaatacgagaaatcccgttcggatgcgtttgcggcgccgttaaagggattacaccagaagtacagatcccatcggtcgctgccataggacacagggatattttcgtcatactggtagcagacaaagtcctgtgcgatggcttccatgacgggtttcattgctgcgctgctctccaaacttgcctgacggatatactgctcccattcttcgcgggtgtggctgtcataaaactgtttgtttgctgctgcctctgcttcggtgcatagagactgcaggcgtagggagtggacgtcttctttggcatagcctttttcaaaccatctggtatcaatattcatatgagaacgatcttcgtgaattttcattttgtatcctcccataataatctttgtttttctcttgttaactcgctttttctcacattttcatttcttcatagagatattttctaagtctatgtcattccccttggccataaatcatggatattcggatgtttagggtacacaaaacaagacgtcgtcttattctgctatgatcggcctttctttccccaactccttacggcagcctaacctcccatgtcatacaggatctcctttacttctgggtccttaattccttcgttctgcttatccataaaggggcgtcatgatgctccttcgctgagtctctgctctgatggtaagaaatctgacttggctctctatgtttatgaatttcttctgttcctttcagcaccttgcggcggacgtctcctgaatctcacagtcgttctttttatgctgcctgcggctgcctgtgaatgtcagaaagcatcttctgcgcatcataggtcactccatttgcaaggatggcataaaagacccgtatcagcttacagctgatcgcaatcacggattgtttcttcttgagcggattattcgctcttgtcgtgtaatactcatgcaatgacttaaactctgggttcttcgctatcagcggaattgctgcattgaacagcactgcccgcagcttactccgacctcttttgcttatggtcgtctgtcctttgtgctttccagagctgttctcccgtaatgagagtcctgccagcttttgtatctgtctgggtgattcgaaacgcctcacatcacccacttctgccagaaatccggctaccgtgatcactcctatacctttgatggcaagcatctgctcgctttcgggtatcttcctgcacagcttttctatctcctccataacggcgtccagctgtgcctttttgtattcgtaatcctcgagcaacagtttcatttcataccgggccgccgaagagcctttctttaagccgatgctacgttttgctgtctcacacagggtcgttgcccttttcattcccacagccctaagctttgcatcacgccagatttgattgattttctcagctcccagttccacgattgcttccggagtacaaactttctttagaagcagcatactgctctgtgcttcatagtccccaaacacatctgtgtactcggggaaatatatggcgaaccatctggcaaatctgtttttgatctgggtcatctccctgatgagtctcttacgattggccaccataattcttaaatcagcatacacaccatccggtgtatacggtgcagaataccggccctcggtaaccagctttgcgatcaccttcggatccttcctgtcattcttgctttggctgttatcatccagttccttggtctgctttaccgcataagggttaaccataaccaggaggatgccctcatcctcaagataagcgccaaggtcaaaccagtaatgacctgtcggctcgatacctacgattgcatccagcttcttatacttgtcctgtaaatgctgcatccatgctttaaaggcttcaaaaccttctctgctgttgctgaacgtaaagacttttccgagttcaatgcctctccagtcaaatgccctggcgtactgtgttgtgcttccgatatcaattccaactaccaaagttgattcttttacttgattgattttttcattctgcttataattcatttgtgggtgtctcctttgaacgatgattaattaacctgccagttaacaatcattattctatgggtggcactcattttttgcaaaccggttatttgttacttaacaggaatgctccttgtgtatagttgctgcattttttgacgcagtgtggtcattggtctttccagtcatagagccgaccatttctttcagactggcgatatactgcttccatgcctgcctggattcttcagcacacttcaactcggcaagctgttcttctggcgacagggcttcaaactcgcattggctgcagtccctatcaatatcctgaaagatgcggttcaggatggagagagccagctctgtaacagtggggctgtgttcatcaagtgccttgcggccttgacggaacaattccagatagcgttcatattgctgttcgctgataaattcccagccgtaggcttcctggatgtcgctttcgctatggtattgcatagctgcttcaaattctgcctcgcggtctgcggcttccttttcgatgtgccgcttgagcttggcgcggatgcgctccaagtctttgagcaaaagcttgcaggctttggcctccatgagataaccgtgtgcttcgctgtttagatattgctgggatgtatttttcatgcggcagcttcctccttggatttggattgaacaaagagtaggaacccttcgctggtatcctccagaagctgccatgtaccatcccgccagacgcaggcggttgcatcgttgtagacttccggcgtcttgggcgggtcgtcaaagcattccggcgtcacataaaggcacatatgtctcatatagaagggctgcagagctgcttctatctctttgcgcaaggcaagggcgatggattcgatctcgtcaatatcctgacgctgaaaggcagcatctgaaatctgtttgagccgcttggtttgcttcacagctgtatcgatatagggtacagcctcatcaaagtatttgtgtttgatccgcataccgtcaaataccagaaagcgggtataggcggtagcggctttacagatgtcttgccgcagggcatcaaatggttttttgtacttggttttcagcacctccatggatacgacctgcagattgcgccgcagggtttccagatggttcactaaagtggtgcgtagttcatctcgttccataggcatcctccgtgggtagcttccgggcggttatccgcgccggaagtggcggcagtgcttatgcacattggcgtgggtaaacgcaaagctcttgcaggccagcaatcggttccgttctctggaagattgccgggcaacgcttgcatgatactttttaacagatgtttttatagggttattcgagttcaggttcccaaggggtatcttcctcataaggctcagcctcctttttattgtcagcggacttgttggcagcccgtaccgtcagcagaagggcatcttccccgacatcgctgctgtgggactttttggctcgtttctttttgcatctttccacggctttgtcatagtcgtagccgataccagcttgcagcttatccgcaattttacgaagcttttcggcatggtactcataggtagcacgatggaatccagtcagctcccactgatcgcacaccgattccaaaagccggacatagtcccgcagtgcgttgactgttttgtagatatcgccatagcaggtagtaaaggtatggacgccatcaagatcccgaaagcaaaaaatcagttcttcccccaaaaactgttccagttggactgattgtgcgatcattggccgaaaagattcctggggcagttcgagcagtctgttctcatccattgctatcctcctcatgttccggtattggcggctgtgggcctaagcctgccgcaaacatctgcacagcggtacggtaaccagaggcgtatgcctgctccaatacagcagaattgcggcattgtaccgcagtctgatactgttcaaaagcgatggacgcctcgctggagagcagcggaagcagagctttttctttctgttgtactgtctggttaaaaggtgtgaagcgtttatcgggcttgaacacatctgcttcatattcgccgtaatagagcgaagtgagaaagcgtgggtctgccggaaaggatatagcagatggtgcagggcgggaaagcgccgccgcaatgtctttgagtgtgttaatcagtgcggggagctgaacattaaaaaatctttgccccattgctgtttcgtgtaaattcataaaataaggccccctttctaaaagccatttgccttttactgttccccggcaatccggtgcaggtctgctaacaggtgtcggttattctgctcatactgaggctgaaaaggctggtctaaatcaaaattgtaatagcggtagtagagtaccttgaatacaatgccttgccgcatggcagggtcaatggcgcgcatcagtttgcccagttcggtggcaatctcatattcccgctttacatattctttgtcttccctcttaaaattctgatacaaccagtccttgacggatacccggctgccggtaaagtggctccggtgccggtccagacacaggcagtattcaaaatcacggccacgctcccctggacctacggtaagaggatagatacggcaggtacgggtacgggcagggtagacggaacagcgcccatccataaggaagatacaggagccgtttggggcttttgtcttgagcatatagatagggaagccttcttcggtcagaggttctggatcgcagtagcggaacaggaaatcctctattccttcgatgagctcaccttttgttcggagatagcgagccagacggtaggcatccagactttccaccattacacagccttcaatattgcggcagcatgccccgcattgacggcaggaaaagggaaactggtctttggggcggactggttggatctcattcatgatttcttcattcattttgttcctccataaaaagagccgtgacggaatggtatccgccacggccagaacttgtggaatagtcagcgggagccggctgttccaaaccatttacagtcccttcacgcacatgcggccaatctcacagggagcggactgacagccgccagcggaaaaggggacatggacagatggtagtgggagttctgcgtttcaaaacggacgcaatcctccgactcctccagaatcgtcaccacacgcgaagtatggtagatgtttcctccggcgtgcagaagcgcaccacgcccaacagacagcggacgcagcagagagccattcaaaacgatctgtttcttttctttcttcattcggtttgacctccaatctttttgaaaatgtggatgtaagggtatttcttatctgtaatgggttcatccatagcaaatgtccagcagtacatcgtggacttcagccagcaactctttaatgcgccgcatgggaaccttctgggtgcgggcaatctcacggagaccatagccgccctgtttcagatgaacaatatccatttgctgcttggagactctgccggccagctcgtggagcagaagatccatttccaactgctgcatgattgggtcatgggcaggaatggtatcttctaaaggtgcaccatcgggatataatccgacgtgaatactgagaacctccatattgcgcttgcggcgctcctgggtgcggaagtaatcatagagccggaatttcatttgtcgtgtggcgattgtgctaaaagagaatttttgtgcagatggagagttgaagtaatcttttactgcctttaagtatgcgaaaacaaccacatcataaaattcatcttccggtagatgattttcattcaggaacttgtagactagtccgtgatgatcagtggcaaatgcctgttgttctttggttaatggtacttcacataacattgtgttttcctccttaaataaaaaaagagggatacctccggtgtgttaaaccgaaggcatccctttgttcatgtgtcatgtggcgcaggccacatcagaatacttatgcgggcagctgctcgcagtcaccattgatctggctgacagtatagtgaccgtctgccggctcgttggtcatggcgccaggctcgattacataatcgcagccggtgtcgcgctgctcctcagtgatctcggcacgctgctggagcaggagtttgatctgctccttaaaactgttggcgtaagcccggatctgagccagctcctcgccctggaaatcctgcagcagtttgaaggtagcaacactgtagtcattggtgccgttgttctcacgcttgagaccaatctgcacgatactgccgtaagtggcgcggcggcggagcatgaaggcccggttcagaaattccttgaagggcttgatgctggtaggaggcagatttacctgcagaggcatgtactcaccactgcgaagcaggtagagcacacgcatatttttacaggcttttcctttgctgccatcaggtgcagaaccaaagcggttcatcacgcaggcagcacaggcgcctccgggagtgccgatgccaaccttgccatccacagaagaacaaagcggcgtggtatcgtcgtcatattcgctgccagccggccagtaggcgcaggtggcgtggttatgtagaatgacgcctaccagattcttttcatagtcgggattgtccggatcatcggacggcatctcaaattggagtgtgccgccggcgggaatcttgacacgctgaaagctcatctgcagaccatcggcgtcctcagccagttcctcggcgctgaaatcgccttcgatcatagtggggagcatgaatttttcctgtttcatcaaatcgctgttctgattatacatagtggttcctccttaaaaattgtgatggttgcagatggtcaggcggccatctgattgatacggttccactgctgtcggggcatggacaggatattgtatccgatcccctccagggcagtggcgcggtcatagctgtccacatcctgactaaagcgtgttacggcattggatagcccatagagggtcagatctttgccttcaatcagacgctgcagaacgccggtgctttcttcctcggtgatattgaaatccttgcttgccagacggacaacgccgggaatatcagtggtattcatctgaacggttgtggcttcacgcatcatgccaactacccgtgtaaaccgcgtttcatccacggcggccatcacggtatctttgatcttcatggcaaatgcgtggtcatcagcggctaacgtctcctgtgagaacagttggaagttttcatctgcctcattgacccggccgatgtgagtgcggcgagtctgggcatcgttgacgaccatgccgttactgcataccagccgatagaccaaaggctggatgttgacggaacccagtccaacttcactattgctgatgataacgccggactgtacgatgtcaccgggtacaacttcggcttcaagccgcttgttgactaccttgatgtacatacggctgtccgtgatctggcagctttcaaaataggcgtcctccatttgctgaatgacaggaaggacgatttctgcaatgtccagattgtcaatgcggcgatagcggttgctcaaaaacgcccgtacagtgccatccagggtgcggaccatacgctgggtcggttcccgctggaaccaggaattcacattctctgccagcagttccggataatcggaaagcatacggtcatagtaagcagccggaatcttcagatgtgtgccgatctgccgatgggcaatctggttgatctccaatggctccaccagtgggtcatcgtggtcatcaaaggtgtggagataaagttgagaaccaaaaggttctacttgaagtcgcctggtatcaagcaaatagtcttgcttgagtttggattggcgttcaatctgctgtgccatttccacgatggtaagtcctgatttcattcgtcaagttcactcctttctctgtgttccttgtcagcagaagcattaccaggatacctgaataccctgggcagtgacttcagccgccagaccattgctttccagtacctctgccagacggggccagtagaccttctggggaaagttgttcagatgctcctgagaaacagcatcttcgccctgctcaatgcagatatcaccgtcttcacgaagcgtcagtttgctgtgtccacgggaattaaggtcggagatcagtgcttccagtacagagcgtccctgcgtttcataccagatacggggatcaacaggctgcctgtttggaggtgttgcatcatcctcgtttgtttctccgccgaccttggatagcggaacgatcttgaccatatcgcatttgatattggcgttctgatccagtgtcacatcagcgtgatcaaactcgtcaatgccaaacacacggatgcggccggtaccgccattgcggattagctgctccggctgcttttcacaccactcgaaggtggcttgcggataagcggagcgcagatatgccagaatacgatggttggtgtggcgaaccagcagttcatcggagctggtgctgcccaggtcagggatctcaaaacttcttgtttggatgccttctgcatggagccgtctggtgcgctgctgacgctggcgatgccgtttagcctgctgcatataggggagaagcaagatcaaaactacccacagtccccagagagtgaaaacgcccagaagtagccaaacctgccagggcccacgtaccagagccataattgcgatgaccgcaccaatcaggatcgtgatgctgccgctcaaaagtcctttgtcattattcatgtttgataccatccttttttctgaatttgttggaaaacaaaaaaagagggaccgcaccaagctttcagtttcattctgaaaaacttgatacggtccctcttgggcgccgaagtaaactactccggcagggattcacggtcgccgtccaatacctctgtgagaggcggtgcgggttccgcagtaatgtccgggtcattctcctgtctgttcgctgcggcgggctgtttggggaggaaaccaaagtcatttagactgaccttcagcttcttttccaatttaccgtccttcatgcgaacatctaccagccgctgtgagccggcaagccagatcacactgccttttttgaccttgaattgcatgagccgggtgacatctgcatcccaggcccatacctgatagaactgcgtccagtttttggtgcgttccatcagatcaaagcatacatagctttgtttggactggctttctttgggtacaaggtcgttcatgacgcgcccgaacacaaaaatctgtgccataacactcctttctgccattggcattattatctatataaaaaagtgccagcagtttttcggccctaaaagggcgcaaaaaatcactgacacttgcatacaaacttaacagcgtgtgcaatgcaggcttttggcctacggtacagatcaaaaagacctgtattcccaaatgggatacgcacaaaaatcaattacaagttcagtatagcactgtatcttgtgcctgtcaagatgtaaaacgctatatatagatttatagccagcgacaagtacgatatgtagtagttgaaaaggtcttactctgtaagatggttcataatacggtagtagtcgtccaatagatagaactgcgtttttgttggagatgcagtttggtagtcaaagatcagaccatataggctgccggtgccatccactcccagggaaccaaaccagcaggacatcgtatggccgttgaaataccatagctgcaggtcgttatattccgattcagtaacgagtcctttgcgtgccagccgaagggcgtcatcttcattgatcagaggatgagacagaaaatggcggtaaagaatatcggacataccaagcgcctgctggtaggtaagcgggttgggattgtccagccaccagcgggtcagcgcttcaaagtcatggatgactgggcggggcgtaaggctgcggaattgttttagaaaagcgattactgttttcggagcagctggagccggtacaggtatttcctgcacacagtcattgagaaaggcaaacgcgattttttcaccggttttgtcctccagcatcagtccgaagcgtgacaaaggagcgagcaggaaatgctccagcgcaaagttttcttccagaaagcgatagactttatattgttcgatggtgtggggcttatacataggaaaccctcctttccttgatctacccaataaatagggacagaaggaatgtattctgcaaaatataaggaaatcaggcgttggtcattgtgatttgcaaaatgccctttaagaaagcgaggtggctcaaaaccacctcgcatttttaggattcagaggacggatcgggatgctcctccggctcgctgattgcttcatagcccaaaaagctgtttgttgaaagtgctgcgtccagatagtcatttccaacgacaggccgtgaccctttctgaaagtaaaatcggtagggctcgcctattttaagcagggccgatttactgagaagcagtgtgatctctatgccatggctgtctatcagatgtactttgcggtagcggcggagcataggtgtactgataccggcgcagatgccttccactacctcgtagttcttatgtgttgcagtcgcccagatccctcgacaggatataagacaggcgcagagtacgacaatccccaatgccagcaggatatgatctttagtcgccacacagatgatgacgctgattcccgcactggcgattccggccagcagagtgagcagaaactttcgctgcaatacagtgggaaaaagagtccattgtttcatcatgctcataccctctcaaagataatctgctgccgcagataaagattggcaacggctaatgtcactggcttgctgctctggctgattttgaccatgctggcaatgttgtcactggtggtcgtttcatctccgtagagggaatccaaaagcgcacattcattggggaggcgggaaatatttttatctatgcacttgatgatctctgcagtggagagcagggcttgtccggcaaggcgcatgaccagagcttcgtatttggtgcgtttatctttctggaacagtttccgcgcagcggataccggaacatgtgccagcagcgtcagcttgacaaaagaggcgagccggaggaagaacggtccgctggttgggataatgctgagcgaaccaagcaggtcatacaaagcatcgtattctgtttcaccgctgccggataccagaagaccgcgggtaagcagtcggtttgtacagtcttcccaagaacgctcggtacagtaaccggatgcggtggctagcttttcgtattcttgtgcgatgtcatcccagcgcaggattctccagttgagcatgctccaaatcaccatttcctgcatatcggccatgtactcctgaccgcctaacaggatgattggacaactgcggttgcagccgtttgtccttcgttcaaaccggccgaccgcagtgtatagggttttgattgccatatttcgatacctccttcttatacatatcccttactgttgctgatgctgattttcaacagatcaaagcaggcaggttaaaaagtcagggtcattgcgaagtttttccagggagcgggagatccaggcgcccacatgggaaggagggacttgatggagggcggcgatgtctgtaatgcgcattccctgaaccttcagcgccagtgcttcgatgccaagtctggcaacgccttgatagttctgtttgctggcttccagcagatcaagggtctccagacgagaaaggtgggagtcaaaatggtcatccggctggtctacctgctctccatctgcggccagctcgccctgttctccgatgatcagccgactgacgtgccgcccctgactacagatttttcggcagtaggagaggagtccatttttcacaacctttttggcgtaggttgaaaactgcgcctgtccggcatggtaggtaaaagcggccttgcagagccacaggcatccttcctgaaacagatctccatactccagaccacagatgccgggatttacatggatgttgttgacaatgacccagtgaacgatggataggtttttttctaccagtgtctgctggtctttggtaagcttaaagttttgcttcatcaggcttcacctccgttcaggcagcacgcccggatgtgtacgccggagcctgctgacagagggaaatgacttgctcgcacatatattcggaaaactggccgatgtgggtctggtgtgcatccagccccagtttggcttgtagccagatatagacctcccatttttccatatggcagtcctgctgcagtttttttagggcacgatgggccagaatgcgtttgtggcgcagatcgccattcgccagtgtccccatggggagcaatgtgcgctcatgagcactgacataggcattgcaggccggccatctgtcgcagacatacaggaattttcctctggtctgtggagtagatccatacacaaggcttgcaggccgaagagaagcgtgagcatgacaataaggacatttgatttgcttttgtttcaataaaatcacctccattacgcgccgatgacggcggcattgcgtcttaacaggcagaatcatccgaagtaggtatcccggtctgggcatagctgtaaaaacggacatacatggtccgaagaggtatgccattccagaaacttggtataagcagtccggaacgagcggcactccagaattgcagagcattcttcgggggccactgcttctccactcagcttccgtactgtctggacggacagaaagatcggctgacagcttgcgtctgctgccatcaggaacccctcacaggatgcctgccggatcattggacaaagtgaaccactgcagcggatgaacagggcgttacgccagttaccccggactgcctgcagaaaggaatagaactgacacggtttttgattcatgctttcacctccgttattcgttatctgcaaataaaaaagggggccagctgcagaagttctgcaaactggcccctgatttggtgcttaggagaacagactttcaatctcctcagtgatgcgggggatgaccgtatcgttgaagatgagggtcagagccgctaggagcagcgcacccaaaactacggcgataatgatcttgacggcgtccgaaatgtaaaaatcgccgcgctgattggacaatgccatacggccgcggttgagcagatagttggctttggtatagatacgggtcgtgaattttctcatgggtaacctcctgttatatgtttgatgattgagtggataggtatatcaagtccaccgtctgttaagcgcggcggataggcttgatccgattgtttttgttggaacggggccggttcggatatgctttaggccgctggaacagcaagcaacgaaagcggcgttttttggtgccggtatcattcggcggataaaatttctttttgggcatagacattctcctgtaaaaaatgaagccgggctgatgaaacagtccggctcagttcagatgaaaagaaatgatgtgcctgccgctatggaaaatcgcttgggtacaaacgctcacctccctgtgtatctgtcttccatatgaggagcaggtatgaaaacgcctggaagtaccgtggcggatgccgattagccaaagaacgccccgagcgaactcataacctcggtacagagcaccaccaggtagatgatcataatacaaatcagcatcatcatagagtaacgctggatctttttgggacgtttggcagcttcctttttcagattgttctgctcgatctgacgcatatcgaaggtaatcattttgaagtacatccgctggtcatcaccgcgcaggacaccaatcaggccacggatcacatcggacagcatggggctgccaatgcgggtttcaaatcgaatgagggcattttcatagttgccggtcttcatatcagcaatggtctgatccagttcggcgccgaagtctttcccagctacacggcggtaggaagtcagaattttaagtacatccctgtcattttcaaggctctggccgacggtcaaagcaaatcggggaatctcgccctcgatcagcttgcggcgctttttaacaaaatcaaaggctgcatagtaggttgaaaaccacagtgccaccgcaagaccaatcaaaataggcaccagcagcggaataagaaatgccatggggatggcacacaggccgactgcccctgcagttacccaggctctggccgtatagacctctggggtaagctgcagacctgcaatgtccagagcgcgttgtaccttattgcgcttgagccggtccagccgcaaataaggggcgatccaaccggcgatttttgtcacatagacatcaagcagcttttcgtttttggtgccctgctgtttgcgggagagcatcatcatttgtgaggtcttcttggtcgggatgtccacaaaggcgcaggtcaggttgtagacagcaaaaccgaagaagatgatggcgatgagcgccagaaaagtcatacgctatcacctccatattcgatgggcttgctcagtttcataatctgggtcagcgcaaacaggatgatggctgcacagatcgccagtgcaattttgcccggtgtggtgaagataagggtgtggaaccaatcctcattcaagaaatagagcagcggcacattggcgataaccagaaatatcatggtgatggcttcacgccgcggcccttgcatcattgcctccagttccgactgcaccacacgcacatcggagaatttctggttgatggtaggaagggtattcttcatactgcggtcggactggcactggatgagggtgccgcaccattcatggaagacccggttgggaatcttcatcttcaggctgttgatagcgctggtgatgttggcattgatcagttccgcttcataaacgaaggcttcaaagttggcttttaccggctcattgatatagggcaggttttccttgacagaacggatcagatcctcggtgcgcaggtaggaagtcgtgatgatggaaatagcggtttccagttcttcattcaggtgctttttatagctggcggcagtgctgcgcagataccagattggtataagggaaaaaccgatacccagaatgggcaccatgtacacattcccaatcaaaagggcaagtacagcccccacagcgaacaggatcagagacagtcgttttattgcctcatagcggtccgcccgtccggtgcccttcaagatctgtttcagttcgtaatcctgattaaaaaagcccttggctggtgtgcccagaagaacattcagttcatccgacaaggtggcggattttcgctgggagcggaagagggcatcaataaaatcacccggcttcacaccaaacagagccaaaagcccagcactgatcaggataaaacagataagatagatccattgcaattaccccacctcctttggcggctgcatgaattcgtccaattccttgttggaaatgccattgtccaatagccttttctttaaggaatcggagatcaagccgatttttttatggtgccccaccacacgggtttcaccacggtcatcagttacattgtcttccacttcatatttgtatagggaatgggcgatcagccgcccgtcctggtagtcctcgccctcgatgatttccatgatcttacgggaacggtcctccagctgcttggtaaagacgatgatgggatacgcctctaccatgatctgcaagaggatggagtcatccatgttgtacttgcgtttggcaagggtcatcatcctgcggtaagtactgttgcaggagttggagtggatagtggtacatacagtatggccggtacgggaactttcggctgcggacaggctttctgccgctgaccgcatttcacctacaccgatgacatctggatgcttacgcagcacccgctccagaagaaaatcctgattgatgttcaacgcagggttctcgctggggcgggtcagcagatgtactacggaattaaggatattgccctgcgcatcccgcttgaccagatcaaattcgcggctgccttcttcaatggtaataaggcgccggttattgggcacattggacagcagccaggccatgatcgtggttttgccggagccggtggagccggcaatgcagacggacaccccatatcggatacaggcagtcagaaagtgaagcatttcagcagtggcactgccggagttcagcagtttttcttcactgacggtctgctggttgacaatacggatggaggcattgacgcctacatccgcatccacaatgggagttttatccaccgaaatacggatgttcttgtccagaaatcccacaatgctgggcatggtgtcatcaatgaccatgccgcaggcgttgagcatcctgcggatcacatcgatggcgtgctggggcgaactgaatttatcagggatcttgatgctacgcccactggattcgatcacttcaatgtcgttgtaggcgttgatgttgacctcctcaacaccgggcttatagatccatttcttcaaaaaggagtagccggccatgtcttcatagagcttggaacacagttcttttgtagagagcccgtcaagggcatactttcgcttgacaatgtagtgttccatcagttctttgagcagacttgtggcacgctctgcattgccttccccagcttcggcaatggtggaggcatggttttcggcaaaataccgctgtacatcctctagtacctggtcataggtcagctcctgattggcggccggtgtgaagaatatatcattcaaattactcatcggcatcctcctcacattcatacgccgcatcatcctctgactgctcggccagttccatttgctccagaatttccagtaccttgttcagtgaagcagtgtatttggggttacagtaggtgatagccttgaacataccgccttcggtagcacagcggtcgatctccttactgtagggaagcaggccgtcaaacccgccaatgatatagcccatttcatccaaggcgtggaaggggcgtgccagaccggcgaatgtcatatgctcagaaaaccggaagcgctcgtccacaagcagaggttgatgggctttcaggtagttgatgccctttaggtccggggtgaggatacggatgaccacatcgccggcttcaatagcggcgggagtgaacacattggtcatgctggtgctgcagtccagaatgacgaaatctaccagtttggcggcagcatgaatgagctgcagtaccatagtatatttgacctctgggtagctcagcgggttttctcctgccgcatagcccatcatcccaatgaagggatagtttttcagcactgtcacatgactggcaaccagagatgtgtcaatctccacactgctcaaaacctggccgatagaggtattggtctggatgatctgttccggcagccagaccggcagcatagggacattcatatcggcattgataatgatggctttccgcttgtcccgggtcaaggctttggccagaatacagcagaacatggatttgccgctgccggggcttccccagacggtgataactttacccataacgaagatcctccttccttgatttgattattctgccgagggtgcagtttcattagtggattgtgcagactctgcagtttccgtttcctggggttcactttcagcgtcagaattttccgcatctgcagcttcttcctcaatcaaagtttcggggaagtagatttcctgcagagtcttatcctgctcggcaagcagctcatctgccagtttgtcattgttgcgggagataagagccacatgagctacgccgtcattttcaagaccggtaatgatcttcgcctgttcagggcttgccagcacagtgatggtggctgactgctgcttttcttcatcctccgtgggctccttggcattatccacattgatgccgtctgagtctgtgacggacaatactttgacaaaacgcagttccggtacttcggccgccgtatcaagaaagtggtaaatacggatgatgtcaccgggctgaagcttgtcagagaggccggaagcaagtgttttaacggtcagcgagatagcaaccttaccggaagggatgctgttgagcgccacatcggacgaaaccggtacagagctgatcttgctggtaaggatatagtcacccacagccaagtcggcggtagcgtaaagaccatttacatcggagagctgatgggcgatgttggaggggaggttatagccgcctacctcaaccacctcggcattttctgacgagatttgctcgcctttcaataccggctgggtgatacggacgatttcctcttttccattggtctgacgggcgatggttggaagtgccacaaaggcgataactgccgccaacagcagagagaggataccgaagatgaatcggttattcagtttcataagcgttgtctcctatcttaaaaatagttgggccagggtcgctgtacagcagccacaggcgagaaatggcaggaacgggatagcaaggggctgcccagttcgataaagccgcctgagaagaaagatcacaggcattgcgataacagcggcagtcagaaagaccagcgccatgccggaagggccatagaccagccctaatatcccgcagaacttgatatccccgccgcccagaccggtgccgtttgttgccagtgcagctgccaatggaatacaaaagccgagcagggcgcctaccagggcatgggtagcgaccggccagaggaagagcggcgggagcccatgatttaacagaaaatacccttgcaggaccggcgccagggaagctaaggggataaaaaagacgagtgcccggtcaggcacccgtctgtaaagcacatcgtagacagcaaagccggccaccacaaaaaatatggtaagcaggtaagctgtccagaggttattctcgattggtataccagtcatcataaaggctcccttggatcgaaacatagtcatttaggttgatggataacatgccgtcaggagtccaggtatcccacacctgtgtatagatggtgtagtcggtggcatcggggaaccacagcggtgtgaaatgcactgtccggtcataggtggaaaattcgttgggcttgaagatgaattttgcactttggccgccggaacgctgcagaagccgcagataggtctgatactggaactcaggaaatacggaaaaagcagtttggggataagtaatgtggctggtcggggcatctgtggacagcgttgcccgcacttcggttttaacgccgtacccgcttttcatcgtcttgccggatgctgtgggtacaatatcgtctggcattagggacatctcgccgctgatggaagcggagtagcccgtatattcgtattcccaatatccttcatcaacccagtgcccgccatcttcaccgtggtcgcaccatacccatacaggcacccagtagcagctccagacgccccagttggcagtgagcttctgcgtttcactgggcaggggcggcacagagtagccgggattcgtgtcggttgccacagggtcaggtggaatgtgctcattcagatccacgatttttgcgacaaaggtatcctgagcggtataggcgccgctgacagatactgtaatggtcacggtctgtggggtagagggggtatgccatttgacccagactacctggctgtcaccggctgggatcactatatcattgacccggtaggtggtgccgagaatatggaaggtaaccgatgccggattatccggcgtcagatcctgatctgtccgcagtgtgacggcggtgatcacatccgtatctactcggtattcgacatcaggggcctcaatttctccttccggcggagcttcatcaaaccagacgataccaacgccaagggtgctgatgatgtcggaattgttctgctttccagtggtgctgcctgtccaggcggagatgccaaggtcgctgaattccaggaacattgacagcggcagatttttatgggtaagcgaggtcatggttttccgcaggttgccgccggacatctgatcatacagaccggcttcagtagctgtcatacagtaatactggccgttgtgcgtgaaataggcaatgggctcgatcagcagcttgtactcgccggcaatcatccgctcataatcgactccggctgcctgagcgaccatcatgcacgcatattcagaacagaaataccgtttgatggcttcgatgttgctctgccccttgctgctgacgattgtgggcatagattgcgtaggtctaatgcaggaataggcaacgccggactggagggacaggccggcgccgcccaggtattgcagtttgttgacttttccaaaatggagaagactggtcttctgtgtccggtttgaaaagtccagcggagaagatacggcagttccgctggatgcgtcaacaacagtaatgcggacgccatcgttgcctgagttccagaagttgctgcttgtgccgtgacccatgctgccaccgccgccatctatgtttccatttccgcccgttgcaaaggcagaggaggggaatagacagaaaacaagggtaaagcagcataggaaggcgagaagtcgtttcaaatacatcacgctccattccttttgaaatagaaaggccgccacaatcctgtgacggccaagtagtgccatattcagttgtagtaaatcagcccatattgccgacctgtttgttcagatccccatcgctgtcaccggtggactgctgtacattgccgggaacaacccagccaaacaccggatcatatacagctccatttccgttgctggagcctggaaccggctcattactgggcggcgcttgctcggcgggcggggcagtaacctccggaactgacgggtcgggattgacggtatgctcctgaccaggatctttgatttcggtcttaccttccggcaccggaggaggcgtttcttcaggcttttcagtatcggtgaagtcgatcacaacctcatcctccgtttgggaggttactttgggatattcttcttcggcgtctgtggactggccgggggcataagcatctgctccattatcaccatctgtctgtgtgccgccatctgaccaatcgccggtgacgctgctgggtggggattcatccggtctaaaatctccggtacggtcgcggcttacgaaccagcagacacccagaatagtgacgcagaggagagccagcgaggaaacaataaagcctttggattggaaaaacttcttcatattttacatacactccttttttgctgttatataaagcctatacggtagaatgtgccgggctttcaacagtattgttagaattttgtgttgtgatagcctgtcagctccacccgttgggtgatagacggataactatggccgaacatccgcacatagaactccacgtcacagtaaaagatgtactcaacccgtccatcctctacattgaactccaggctgatgtcggaaaccttgtaatcctccgttgaaagcggaatcttggagtccaggccacctgccactgtagcctccagcatgtcggtatagtcactgctggagtaaagggtatttaggtactcttcaaagttagtttcacgctgggaacggtaggtatctgcataaatcgtgccgctaaggttatttaactccattttagcgccgttgcggatgttgatgcaggtgatccggatggaagcgtacaggagcaggaaggaaatcagcattacgatgcctaccacaaaaaagcaggcgaaaaaggtgatctcgccccgttcgtttcgcagtggctgtttcaaccgcaggaatatgcgtttcataggtcacctcacttccagtagtgctcactgacgccgctgccacgggcaaccactgtgatgtttaccaggtcaaaattccagaacccgcccagtttggcatctccctcgatggtaatgaagaagggggtgcccaactggatggcatttgtcataccggatggcctgggtgatgtgtaggtagcgtcaatggagtaggaaatattttcggctccttcgatctgagaactcaaaaattcaaacagctcatcggtctcgccgttgacgccgccggaaagctgaatctgtttgaccatctgatcggcagcatggtcaagttcctgcttggtggaaatgatgctgaacaggtcaataatgaaggccagcagcaggacagcgatgaagatgaagaccaccgtactgaaatagttggcctcgccccgctcgttgttcagcaccttccgggctttttgaaagagaatagaaaccaccacctttactgaaattgaaaacagccgctccaaaccggagcggctgctatgcaaagttttgactgtaccaagtataacagatatggatttacggcgaaagggcaggactgtgccaatgtagagacaattttgtgccaaccatgtttctttgagacattacagcagtgattccaccagcttatagatgtcggtaaatggattgacagcaattccaaacggtttgctgctgtcattttgaagatggtattgctctacacgtttggcgttctgaatcgcaatggctgtatgttctgctaactgggtatatacatcgccagctttctcataatcagggagataagtggtcaatgcgtttttcactgcggggtagtctttgaaaaatttggtggtgtactggaaatgcaacagataccaaaattcaaagcagggattagagagtgcaatctgaatccccttcgcatctgccattttccttgccttggagagcagattgtcctttgcagtgatggggtcagggttgttgtagttcacatcgccgtctgcaactacccatacagagtctccctctgatacggaaatctgatttttgttctgatattccacggctttccggatcaggctgaggtaatcagtttcacctccgctggtgcggctgccgaccacacgaatatcaatgtttgtctgacggttgcggtagtgttcaaaatacttaggctcagtttgagagccctccgtcacaatcagaatgacaggctttatttttctgcgtcgctgtccacgcttttcaatttttccacgtgccattttacagccctcccttgataaaggggatcgcaccataacggccaatcagatagcccttctctaccttggcatccttgcggatggaaaaatcgtaaagggagaacagatcggtagccgctgtttgctcgtctttttcggtaaaccaaatctgatctctcctcagtacatccaagtcaagaagattggtgttgtgtgatgtgaaaatcaactgggctccatttggattgaactccacgctgttaaaaagcgagaccaggtgctttgtcagaagaggatgcagatgagcgtccatctcgtcagcgacaagaagcgttccttcatccagcaccttttttacaacaccgatcagtttgaaataactgttggtgccatcagattcctctgccatgttcagcgcgtaggaagaagtatttccctctgtatcctgtaccgtgtgaatggcctcaatattggtaaagatatcattacgctgagaaggagcgggttctgcatcacgcatctgaagggactgtatgccaaaatctgcaacacgcagcatagaggcgatcacatgccggtagtcatcatctttgagttgttctgcttcaaggccgtaggcatctgcaacagaatttttcgtgatgatctggcaggaagcaaaccattccagaaccggaatcactttggaatagctccagtttgatgcgacagacagatagagcttgttggccgaagtgcgatccttgagagtgttttgttcatcgacatcaacggtaaagcgaaaatcttttgtgtcttttcgctcaaaaatgagtgcctgcctgccattgggatagtaatacagatattcttcaataacagccttgtctgttacagaaaagccatacgcatatcggatgccatttgtggtgaagatgacctcaaagctgctggggcgagagggtgtttcccggtcaaacttgaaaggcgaacgctcaatggttttgtggagctgctggttatgcgaagtcagcacataatttaccatgaaccaaaacgcattcaagacattggactttccggaagcattggcgccgtaaatcacggcagactttaaatgctttttgtttccgtccacaatcaggtgctccggatgttcgttatccttactggcaagcagggataacacgacattatctttgatagagagaaagttctctacactaaattgaatcagcataaaacaacctcctaaatccttgctataatatattatatccgcatttttgtgaaaaatcaacgcaaacgaaaaataaaaatctatatagaggatttaagagaacagccgtgtggagaggatatgcggcgggagtttcggtaatgataaaaagcaagcctgggaaacagttcgccgctgcttcccaggcactttgcttacaggttctgacggatgatccgagtgataatacctacggccacaccccgctccatatccagacgagtgacggcaaaagatacatcgtcctttttgccgggcatccggtagtcatagcaggagtgggctaccgcattgacgccgttggagaggcgcacatagacaacgcccttgtggacatctgtgacacgaccggcatacttgccctggatacggcacttctgcaggttgtccctgtcggtgttctcggaaatactcttgatgtcagccttgatgcccaagtcctccagactgttgcgccgcacgctgagaatccggaccagcacctcatcgcctacggaaaaacgctcatgggcgtcaccgatccagtcccaggcaaggtcacgggcaaggatggaggtttcaacgccgaaaacttccacgcgcacaaccttttcggccacagcaatcacacgcgcctggacgatgcggccctcatagacacggtacataccggtagcatccgtatccagatagaaaatctggcgtttgcgtagcatggcctccttgcggctggcaactacgctgcgggttttggagtcgataccacgcacgatgaagtcaatgtcagcgccgagcatgttgccaagaatcttattttggcgcagcataaggtcggcatattcctgaccggaagggctgcggcccagattgatcatcatttccttgatagggataataacacggaaccccttgtaatccacaactgccaccgtcttgcggttgtccagctgttcaatgccgcccagcttgccggtgatgatcttgcgggtgcggtaggcattatggatttcatgccagattacatcatcacggtcttcggcagtctcgacatcatcccggctgcggatggtaaggacggggacctcgctgcgctgggggcggggctgacgccggggaggagaaggagtgggggcaggagcggcagcttcctccacgacaggaacatcaggctccacagcaggttcctccgtatcaagaatagtgtcggctgtatccgccgactctgttgtttcggcaggaacttcctctgtgacagttttttcaggagcagctgcttctttcttctttcggctggtacgcttgggcttgggaggtgcaggggcttcctgcacagcgtcggcgttattttcgtaaacatcaggcggctgcacatcagagtcttccggcatatcagtgggagcagtgctttgatcgtctgtttcagcaggcgtatccccgaacatttcctcctcggtgagttcaggaaggggatcttcagccatatcttcggcagaggtgtcctcctggggctgatccatctgccccagcagttcgttcaaatccagaccatcgccagcgtcagcaggaagggattcaggttgagcggtatcggccagcagagtttcgccttccgacataacggtttcggtaacaggagcgtcctgttccagaagttcttttttcttggttgccatagattaaaacctcctatgaatttgatagttttgttcaagacaggatggaatccttgtctgtggtgataatgccttccggcgtaccggcagatttagggaccggagcctctttgggtgatttatcagtgggggatgccggtttggtggctttgcgctttgccggtttctttgctgcaggagccggtttcggcgcgggctgcggtgttttggcggcttcttcttccaagcggcgccattccggtacatgggcagatgctttgcaggaacgcaggtacttggcttccgggtgtttggagtaatccattttgtctacctgcagaaccttcttgccgcggatgatgatgagtgcctgatccagcgggagccgcaggacttcatcaggagtaagtacagggcgttttccaacaccggaggtctcacgaaactccggtgtatagttggagatacgccaggtgcccagctgtttggacttactggatactgctacggaggcaagccctgtcctggcagaaataaattcggcagtaagctggtctgtacagcctaaaaacaactgcgcgtcacagtttccaatgatctcctgccacaaattctgcgggtatctgttctgcaatcctgcgagattttggaacacacaggacatggagatattccgggagcgtattacgctgagccggcgggagaggtcggggatcgtgccgcacgctgtcagttcttccccaaggatatggacaggcacaggcagtttgccgccctcgcagttgtggtctgcatatcgcaccagtttgatgaagcagaaagatagaaacagcgaggccagaaaatcaaaggtgctgtcttggtcgctggtaacgaggaagtaggcacagggctgctgacccggaagctccagatcgatctcattcttagcggtaatttttttgatcagctcagactggaatacctgcaggcggctgcccagaccgataatcacgccgcttcgcactgtgtcgctggcctgcttgaacaggctgtagggtgctttggcagggtgcgtggaaggaagcgcctcgaacaatgtgtcaagttgggattccccattgagggtcagcagccggtagacttcgccaatgttgcggttttcttccgcatagccttgatccacatacagtaccaaggccttgagcagattcatctcgcaggcatcccagaaatggtcgctcttgccgttgttcgtggtgttcttgatgatgacatctacaaaaagctgggccattagttcctgtccctcaacttcggcaaggcaacaccaggaatctgagttttcaggggaaacgaggttgaataccttgacacaatagccccggctgcggagaaattcgcttgacttctcgtacaattccgatttgggatcgcagatgatcagcgattctccggcgccattttcgcctcggacagtggcctgaaggatacggttcatacaaaacgaacgggttttcatggaaccactggcgccgtagactgccagattactgttgattctggtatcttccggtatgcagactgctttgccatccagcatacccagtacaacacccttgtgtttgcgcagatcgggcaccagatccagtacgccggacatctctttgcgggacatccagccggaggtgccataagtgcctttggcggagtaggagaaattacggtcttcatcatactcgccggcatcaccatatcccatgcgcatgaccatgatgagcagcactgctaacaagccaatgcagatcaaaatgccatacacgccataaggcggtcggagcacagaggaaaggcagagaaggaagtcgggcgaagcggccagcggtgaagtaccatcgccgggaataccgccgccctgtttccaggttgcatagttacccaaaagctgtgccagaaagccgcctgcgtataggattgcaagaatggcaaagggcgctgcaatcaggctcacgatcagttttttcttgtttatgggaacaacctcccctcgaattttgtgaagtcaatggtctggaagcgcatccgggaaccgcagtagctgcgaagtacctctgcctggaagtcaaagcagatcagtgtgcccgggcgctcggatagttcgagagaggtgttaaagcgtgcgatacggggcagatcgcagaaatagccaaataggactggtgagccatccggtgaaatgccgtcatgctcaatagccagtccgggctgcctcgcagtaagaccttggagtagaatgcgatccagctccgcagttttcccagggtcgcacaacagtgcaagtatcacctccccctgatggtcgttggtaagataaagaaaatgctcatagctgccatccagcatgaagaaatcatgtttgcgtcctccggtgctggtcaaaatctggtaagccagatccatgctgttgcccagaatcagtccatgaacatcctcatggcgaaactgtggggacaggcgctgttggcagattacgctccaaatcaatgccttgacccgcatttccgatttgtagcgccacttcatcagggcgctgctgctgttgtaggtcacgaagatgccggagggcgcaaggagtattccagtggagcgggaactgcggatcttcgtggtgtcgatccccatttctttcacttctctggaactgaaaaaagcaggatagacaatcctgccgccagcgtaaccctccggcgcaaaaattgccggtttttcatcccgatacacacatacacccgcattatccatggtcatataggtttctgccaggcggtgtagccggagtcttcggtcaatttcgcatttcaaacggttggtgtcggtatctcccgtcaggtagctggcaaacctgtccggtcggctatccagtagagtggctttggctcgcggccccagacggtagccgcgcagtttatcccggtaataggtacgcagcagcccgtcttttttcagtgcagtgacaacagactccagataatatggactgccgggaagtctgttaagctggtctgtggggaactcgccggagatggcagtcagagagagaagcttgtacgccatcgtgtctggctgtgggaatttcccaagtgatcacctccttgtggtgtgtggcttttaccgagactgcaaggaacttcggtaaaaatccgtggtgtaacgacagaaaaaagccccgaaatccggggcgaaatacgatgttgcggcaggtcggacaagcaatggctgaaaatgctcaaaaatccgagatggattttagggtgttttcatgctcagcaagccaggcgggaaaccgctttttttccatgacactgattctggtacagtccttttcgcccagcgcagcggtgttgtaggcatcgcagagcaggccggtatcgtcagccatgacgaaggtggagaggacatccagaagttgcttttcttccagattgtcgtagtcacggatacgccgggtgggaaggcactggtcataaacctgcgtaaagcacaccacacaatcgctgaagtggggcatgggatgctctttggcgtattgctccaatgagaagtagaacgggtcgagcagaaactcagtgttttgcctctgcttgcgttttgggagcaggccaggcagggtgacctccagtacaccgtcctcatagacaacctcaattccgtgtacaataccggcggatgtcaggtaatcgcctttgcggatggtggtgctggaatatatcaaatgccgtagcctgcaggcaattttctctgcccgcagggcggcatcagtggataagacttcatagttgtccggatagcgctgaatatccgtggtatccatcgcgtaaagagcattgctcaaacgggatatatcatcaagaatgcttccaatccggtgtgagatgatttttcgttccaatcaagttcctcctgtttttttaaagtaatgcacctggcccgctgcatccacggtgcagaaaccggaaatgccagggcagtcaatgcggcgaatgtcttccggattatcgaccaaaatgatgcggcgtccaccgctgcggtcatcccgaagcgcatggttgatcagggcctcctggccggaagctgcgtagacgatttcgtatagttcaccgtttgcaaagaagataagcttgaccggaaaatcaccgggagcatggtattccacctgcccgataaaatccaagagtacccaggcagcccgtatcagggagctgtccgattttgctgcccaaccagacggaaagtaaccgcctgtatcagtttgaaaaatacggccctgcttttgcagatgggagagcagggtcttgatgatttcttctttgccagggtgaaagcaaagaagctgctgcatattgagaccgggatacatcgtgacgatccgcagcagagccgcagcttcatttccatagatttcagccctggtcttcatgggtatcacctccaatggcgtaatataggcgtattcaagacgcattaaataggaaggaaagccagtcagtgtaagcccaaaagatgatctggctggcaaaactggcttttaggcgtaatacagacgcaaagcagacgcatagcggcgtctggcaggaaagttgcacatgggaatcacctcgcctttcaaattgttatatctgctgttcggcagatgtggattgttcacggcgttttcgctctacgatttcacgcagctcgcggcggtcggtagtgatcagatccttttccagagggctggctttgaactccaccataatattgttgttattggtagaaatcagaccgtgacctctttcaaagtgagtgatctccattgtttcagcatcggacaggtgcagggcttcctgtacccgctgggcttcgtcatcctccagattcagaatgatcttggtcttggagttgttgatgatgcccttaccaaatctgccgccgtcaaggtcaaagaaatcggcaagatcctggcttgcaaaaatcgaggcgccgccgtaaccgcgtatggttttggcaatttccaaaagaaaatcgccggccaatcttacaccagcagcaccggcaccggatagaagctgccaacactcatcaatgaagatggctttttcttctgtacggtcggctttggctctgtcccaaacaaagtccagcgccacaaacatacctacggtgagcaggtctccggtgagggaggaaatatccaaaacagtgtacttgttgtcgagccgaacattggtctgcttattgaaggtgctggcgcttccgtttaccagacggtttaggatgtgggccacgcgcatcgtttccttggaggttttcaaaatttcgtacaggtcaccaagcaccggcatctcacggtactggccgggctgtgcagggtcttccaaagaggcgttatcatgagtgatgccttttgtgttataggtacgaacaagggcttcgtccaaaagctgtcgttcctcgtgagacatatcggggatcagcagactgaaaaatatgtggagctgctggatctttgctgcaagttcagataactggatgcctggaccgtccagaagttcattcaccgagcggtctacccgccgaatctccatgacattgatgcagtggggactggccggtgaaatctggataaaggagccgcccacattggagcaggcgcgatggaattcatggccttttaggggcgcaacaatgaaaatggggatatttttccgcctcattcgcagcgccatcaactgcatggtaaaggttttgccggctccgctcgtgccaaggatcgacatattggcgttcttatagactgcagaattgaagatgtccacgatgataagggaactgttgtacttgttgacacccagcaggataccgttatcatcacacatctcataggatgtaaagggataacagcttgcggcaccgcctgtcagcaggttgcgcttaccccgctcatacagtttcttttccattgccaccaatggcagggcagataaaaacgcctgttcctcccgaaaatggcaggtgcaggcgttcatgtcttgtgagagcaggagcttcttcatttcgctgaccttccattccaagtcttcctcgttggaggcagtaatggtaatcagcagattcaagtagtagaagtcctcgttgttggcaaggccctctttgagaaagtacccgcttcggatagcgccatcaatgtcatcaaagtcggtgttggtgtcgctggcgtccttgattttggaacggttgatacgcagctgctgtccgactttctggatgatggtttctttgggctgacgggagaggaacatatccatatcgatcccgtcaccggcattgacgataagactgagccagccggctggaacctgcgttttgtagccatcagagggcaccagcaaataagcataatacagaccgtcaatgcagatatggtgaccatgcgtgaagtcaatgctttttggcgcacagaattcggtggcagggatatggtcgatctcactgtcgcgccctttggcaaggtactcagccacaacctcctgtgcccggacggagagcggctttacagcactttcatttctgcagagcaggttatagaggacatctaccgtaaactcatcccagttttccggaacgatgacctcgttaccgcactgacggaggtagttggtagcagtatggactgcactttgcagggcattgattgcctcgccttcttcatcagagcgcttggtgttgctccacggctcatattcaaaaatcaggaagaaacgtcgggtaattgcctcacgggaaccgatctgctgaacgaactggaggtagtcttcctgcatgagcagacactgttcattggtctcctgttccatctccttccgaacggtatccagatggcggttgatctctgcccggcgtgtcagtaccttgatttgcagcttgatggggctgattttcaagtaggatacaaaggaatagatgatgttccgctgttcctgggcgctgcgcagcataaaattgatgggtactacctcgacgaccttgacatagcggtggtctttcgtgtagatgatgccgttttcaattttggaaatcggcagataatctgctaccgggttaaggcaggcgggcttcggctcctgagtgcggatagggcgttttactttgcgctccttggagaccttctttttttgcttggcggttttcttctctttggcaggcttctgctttttcacaggacggagtttttggcggatctcgtagccacgaacttcatcaaactccgctgggaaatcctctctgccggagcgccgtgaccgcctgggagccttatcgggcttgtgtaccttctttttgatatgcttgccgccatgctctgccgcaggaaccgcatcttctgcgctgttaccgcctacaatgcggcgatttcgcaggtactttatgaaaatcagcagaaaagaggaaaggctctcaccggaaactccgataagcgccaccaatgctgctggcagtgcggtcaggcacaaagcgatgatacgggcagtcaggccaagagggagcaatgaaaaaaccggcacaccaatggcaaatgccaggatgccggcttcaatcacattgcgggctttgaacataccaccgaagaaggtgcctgactcgatgaaattcggtggtattatgtaggtatctcggtcgattttatgattcatgattaacctcgtttccgaagccgggcgggcacatcagccgataatccagaacggaccgccagctccagcgcgccggctggcctcatttaagataatggacagatcccagagctgttcgctccgtgtgtaactggcagggtcagccaccatgatcttgccgtcttttacgccacgcaggacaatgaagtgaccggaagaggtaaagtggccttcagacatgattgctactaccagtttaccattagccagtgcgtctgtgatgcgctgtggttccgcagtggtacagccggaaaccggaagcccccattccccagcggcggcaggtatcagcgcatggtaagaaccactgcttttacaccagtagccgttgttgtaagaccactcggccatctccacagggttaaccatatcgtccgtcagagaggacaccacgattgccatagcggtagggccgcagccataaccgccaatattgtccgtaccatatgctttaccggcatagcgttcatccagttgattgtagtaaacaacaggtgtgatcccgtcggtgaaagtaacatcgcccagagcggtgatgctgtttccggtccacgcttccagattttgcagcagaccatcgcccaagaacaggcttag
